United States Patent 11,446,398 (REGULATED BIOCIRCUIT SYSTEMS) - sequence listing, part 95

SEQ ID NO: 204470 - DNA, 1461 bp, Homo sapiens
  Payload ID: 20332
  Gene Name: zinc finger, DHHC-type containing 4
  Uniprot ID: Q9NPG8
  ENST ID: ENST00000396707
  CDS Start-End: 359-1393
gatgtcacgagcccgcaggaagtctcgtatcgcgcccgggaggcgccggagcccagcggctggcgggccgccgtcccacccccacctcgcccgagtccggggcggccccggtgtcccctccgagcctgctgcactccacgtccccctaccagggctccagcccccagggaaatctccgaccaggcccgcccaggagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagc

SEQ ID NO: 204471 - DNA, 1485 bp, Homo sapiens
  Payload ID: 20332
  Gene Name: zinc finger, DHHC-type containing 4
  Uniprot ID: Q9NPG8
  ENST ID: ENST00000396709
  CDS Start-End: 442-1476
cccgggaggcgccggagcccagcggctggcggtaaggccgcctccgcggggctgtgggaagcttgggctgtcccaggaccgtcagtctcctcctctgaccctccctttccccttgtgtgtagggccgccgtcccacccccacctcgcccgagtccggggcggccccggtgtcccctccgagcctgctgcactccacgtccccctaccagggctccagcccccagggaaatctccgaccaggcccgcccaggagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatgtaggctgggtaccctgaatcaccccctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtat

SEQ ID NO: 204472 - DNA, 1552 bp, Homo sapiens
  Payload ID: 20332
  Gene Name: zinc finger, DHHC-type containing 4
  Uniprot ID: Q9NPG8
  ENST ID: ENST00000396713
  CDS Start-End: 450-1484
gatgtcacgagcccgcaggaagtctcgtatcgcgcccgggaggcgccggagcccagcggctggcggtaaggccgcctccgcggggctgtgggaagcttgggctgtcccaggaccgtcagtctcctcctctgaccctccctttccccttgtgtgtagggccgccgtcccacccccacctcgcccgagtccggggcggccccggtgtcccctccgagcctgctgcactccacgtccccctaccagggctccagcccccagggaaatctccgaccaggcccgcccaggagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagc

SEQ ID NO: 204473 - DNA, 1348 bp, Homo sapiens
  Payload ID: 20332
  Gene Name: zinc finger, DHHC-type containing 4
  Uniprot ID: Q9NPG8
  ENST ID: ENST00000405731
  CDS Start-End: 293-1327
gatgtcacgagcccgcaggaagtctcgtatcgcgcccgggaggcgccggagcccagcggctggcggtattctgcctttgactgcaactcttgtcgtcttatgtgggtgttgaattgatctgtctctgcagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttga

SEQ ID NO: 204474 - DNA, 807 bp, Homo sapiens
  Payload ID: 20332
  Gene Name: zinc finger, DHHC-type containing 4
  ENST ID: ENST00000483589
  CDS Start-End: 312-807
ggagcccagcggctggcgggccgccgtcccacccccacctcgcccgagtccggggcggccccggtgtcccctccgagcctgctgcactccacgtccccctaccagggctccagcccccagggaaatctccgaccaggcccgcccaggagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgca

SEQ ID NO: 204475 - DNA, 4666 bp, Homo sapiens
  Payload ID: 20333
  Gene Name: zinc finger, DHHC-type containing 5
  Uniprot ID: Q9C0B5
  ENST ID: ENST00000287169
  CDS Start-End: 1363-3510
ggggttgggcgcggcagcgcgagccgcatgaatgagacaaacgtgcgccgcgcgagacgtcgcgcgagcccggactagggagccaatgggaacgctggaagggttcgagacccggcactgagggcaacggccgcgcgccggctccgagacgagcgacgcctggcgggagcgcgcggcagcggggcgggcgtggagcgtgcgggggccgcgcgctgcttctctgaggcaggacggcactgccgggaggcggcggtgacaacgacggcggtggtgacgggcaccgggctcgcgggtgagacacagtaacctggttgaactctgcatctggaaagctgaagactgaagaaagataagagacattgactagtctggaaacagggacatctttggaacttcgttttcatccacagtaaacttttgaagtgtcatcaattggaattgatttcttcatcttattctgcctattgggaagaacatggcttcaaggattttaagtttccctttagttttacatgaactttgtaggaaacagagcccttaaagggcttgggaataacaagaagagattgaagacagagaagcttgccctgttttccttgccccttcaaagaaaaggatttacagctcaaacttagaacagctgttgtccagctttagccatcaagagagaaataaattaaaccaccattgccagactacaagccctggtgaagtcagggtgtgggagtggtggcattgagaagactacctaaaagagacaaagactgcagtaaacaaagctcctctttaaagttggaaggggcctcaggttccttcttggattgaaatagaaatagaaacacagggcacacctcttttaggtgcagctcacattttatggaactgtagtcgtggaggtactatagtatctcagaagaatttttctttgcccaaagtttttttgccataccctgatattctctccttcttttgaagacctgcctccatccatgagctgtatcttgatctgtctgactgtccatgttttccacctgcaaccatttgcatgtgtacagcctactgtttgtctccagtttttaaactgtacaagttgtgtttcttaatcttcccttctgccttgttctggggaggtggttattcatcatttggaatcacctttccccctcccatgtgctttccttcatttgagatcttttgacctttggctttatttgggagggggaagggtgataaagttttctgtttccctggttttcttttgtactcctctctgttgcttccctcctcccattttcttgtctgttctgccgctgtgtgggcctgggctatgcggcagggcagatttcccatcagagctccaacatgcccgcagagtctggaaagagattcaaacccagcaagtatgtcccggtctctgcagccgccatcttcctagtgggagctacgacactcttctttgcctttacgtgtccaggactaagcctgtatgtgtcacctgcagtgcccatctacaatgcaattatgtttctctttgtgttggccaacttcagcatggccaccttcatggacccagggattttccctcgagctgaggaggatgaggacaaggaagatgatttccgagctcccctttacaaaacagtggagataaagggcatccaggtgcgcatgaaatggtgtgccacctgccgcttttaccgtccccctcgatgttcccactgcagtgtctgtgacaactgtgtggaggaatttgatcatcactgcccctgggtgaataactgtattggtcgccggaactaccgttattttttccttttcctcctttccctgacagcccacattatgggtgtgtttggctttggcctcctttatgtcctctaccacatagaggaactctcaggggtccgcacggctgtcacaatggcagtaatgtgtgtggctggcttattcttcatccctgtagctggcctcacgggatttcacgtggttctggtggccaggggacgcacaaccaatgaacaggttacgggtaaattccggggaggtgtgaaccccttcaccaatggctgctgtaacaatgtcagccgtgttctctgcagttctccagcacccaggtatttggggagaccaaagaaagagaagacaattgtaatcagacctcccttccttcgaccagaagtttcagatgggcagataactgtgaagatcatggataatggcatccagggagagctgaggagaacaaagtctaagggaagcctggagataacagagagccagtctgcagatgctgaacctccacctcctcctaagccagacctgagccgttacacagggttgcgaacacacctcggcttggctactaatgaggatagtagcttattggccaaggacagccccccgacacctaccatgtacaagtatcggccgggttacagtagcagcagtacgtcagctgccatgccgcattcctccagcgccaagttgagtcgtggggacagcttgaaggagccaacctcaattgcagagagcagccgtcaccccagctaccgctcagagcccagcttggaaccagagagcttccgttctcctacctttggcaaaagttttcacttcgatccactatccagtggctcacgctcctccagcctcaagtcagcccagggcacaggctttgagctgggccagttgcaatccattcgttcagagggcaccacctccacctcctataagagcctggccaaccagacacgcaatggaagcctatcttatgacagcttgctcacaccttcagacagccctgattttgagtcagtgcaggcagggcctgagccagacccacctttaggctatacctctcccttcctgtcagccaggctggcccagcaacgggaagctgagaggcacccacgtttggtgccaactggcccaacacaccgagagccctcaccagtccgttacgacaatctgtcgcgccacattgtggcctctctccaggaacgagagaagttgctgcgccagtcacccccactcccgggccgtgaggaagaaccaggcttgggggactcaggcattcagtcaacaccaggctcgggccatgcccctcgtactagttcctcctcagatgattcaaagagatcacctttgggcaagactccactgggacgcccagctgtcccccgttttggcaagccagatgggctaaggggccggggagtagggtcccctgaaccaggcccaacagccccatacctgggccgatcgatgtcttacagcagccaaaaagcccaacctggtgtctctgagacagaagaagtggccttgcagccattactgacacccaaagatgaagtacagctgaagaccacctacagcaaatccaacgggcagcccaagagcttaggctcagcctcccctggcccaggccagccacctctcagtagccccacgaggggaggagtcaagaaggtgtcaggggttggtggtaccacctatgagatttcggtgtgagccttcggcacctcccctccccaacgcctctgcgcctacaccaaagggccccaggtggccaccttccttccctcaaggggctcccctcccgtgcatggacattttttaaaccaccgattccaagaggatgaggagtgttttctaaaatgcagtaggcttggggagtcggagagttggggccctgagactggggtagcaacccccccttttatcttttaagaccttcccttccttgatccctggaccagactcagtggacatttgtgcaattgctcgccctggagggaaccagatcatttttaaaccagaaataattttttttattattgttacggattctatttttttcctcttctgcgttaccaggtgtgtgtgtacatataatatatatatatatatattataaatatcaaagaaattatatatctatcctgggatgggaaaatgagggagggatacatatacggagggggatcttactcttcccattcctcagaccagcaggaaaagaggggagacgtcagtctttttcctgtggttccctctcatttgtcccagttactaactacggaaatagcatcctctgctggtgctaagtgtgattaggaagaagcctggggagaggtgagtctggaattttggtcacaagagggaaggacttggagaggagaattagttttctaggctcattggcatttagtttccctaggaaaggggtcaaaacttcaagacactggtggtggtgggagatcaggaaaataacttggcctagctcaaacaatattggataatcccctccttgggggagagggattagagtgtgctcctactggccccttggagcctcccctagcttacacagttaacttgattttaaaatccaaggccaggagagaagaatccaaaaagcaatatttttcatcacatgccaaaaacgggggatagagagaaggagtggcaggcctaggcccctccgattgtcccttgggggttacccctcagcccacctcactatggtgctgggtagaggggatacctgggttctaacctctaaataggggagatcccagcctccacaaagaggcccttttattttttattctgattagccattttaaaccaacgaggaataaaaagaaatcctgatctaaccagc

SEQ ID NO: 204476 - DNA, 577 bp, Homo sapiens
  Payload ID: 20333
  Gene Name: zinc finger, DHHC-type containing 5
  ENST ID: ENST00000528177
  CDS Start-End: 164-577
gcgctgcttctctgaggcaggacggcactgccgggaggcggcggtgacaacgacggcggtggtgacgggcaccgggctcgcggctgaggaggatgaggacaaggaagatgatttccgagctcccctttacaaaacagtggagataaagggcatccaggtgcgcatgaaatggtgtgccacctgccgcttttaccgtccccctcgatgttcccactgcagtgtctgtgacaactgtgtggaggaatttgatcatcactgcccctgggtgaataactgtattggtcgccggaactaccgttattttttccttttcctcctttccctgacagcccacattatgggtgtgtttggctttggcctcctttatgtcctctaccacatagaggaactctcaggggtccgcacggctgtcacaatggcagtaatgtgtgtggctggcttattcttcatccctgtagctggcctcacgggatttcacgtggttctggtggccaggggacgcacaaccaatgaacaggttacgggtaaattccggggaggtgtgaaccccttcaccaatggctgctgtaacaatgtc

SEQ ID NO: 204477 - DNA, 2817 bp, Homo sapiens
  Payload ID: 20333
  Gene Name: zinc finger, DHHC-type containing 5
  Uniprot ID: Q9C0B5
  ENST ID: ENST00000527985
  CDS Start-End: 497-2485
cttacgtgcgcgctctcgtcttctcgcgtgcgtacgtcgttgtgttgctgcagccaatcaggccgcgaggtcgccgcggtcgccagggttcgcgcgcacgccccagatcggagtcggggtgggggctatgggtgaatgggagagtgagcggggttgggcgcggcagcgcgagccgcatgaatgagacaaacgtgcgccgcgcgagacgtcgcgcgagcccggactagggagccaatgggaacgctggaagggttcgagacccggcactgagggcaacggccgcgcgccggctccgagacgagcgacgcctggcgggagcgcgcggcagcggggcgggcgtggagcgtgcgggggccgcgcgctgcttctctgaggcaggacggcactgccgggaggcggcggtgacaacgacggcggtggtgacgggcaccgggctcgcgggtgtccaggactaagcctgtatgtgtcacctgcagtgcccatctacaatgcaattatgtttctctttgtgttggccaacttcagcatggccaccttcatggacccagggattttccctcgagctgaggaggatgaggacaaggaagatgatttccgagctcccctttacaaaacagtggagataaagggcatccaggtgcgcatgaaatggtgtgccacctgccgcttttaccgtccccctcgatgttcccactgcagtgtctgtgacaactgtgtggaggaatttgatcatcactgcccctgggtgaataactgtattggtcgccggaactaccgttattttttccttttcctcctttccctgacagcccacattatgggtgtgtttggctttggcctcctttatgtcctctaccacatagaggaactctcaggggtccgcacggctgtcacaatggcagtaatgtgtgtggctggcttattcttcatccctgtagctggcctcacgggatttcacgtggttctggtggccaggggacgcacaaccaatgaacaggttacgggtaaattccggggaggtgtgaaccccttcaccaatggctgctgtaacaatgtcagccgtgttctctgcagttctccagcacccaggtatttggggagaccaaagaaagagaagacaattgtaatcagacctcccttccttcgaccagaagtttcagatgggcagataactgtgaagatcatggataatggcatccagggagagctgaggagaacaaagtctaagggaagcctggagataacagagagccagtctgcagatgctgaacctccacctcctcctaagccagacctgagccgttacacagggttgcgaacacacctcggcttggctactaatgaggatagtagcttattggccaaggacagccccccgacacctaccatgtacaagtatcggccgggttacagtagcagcagtacgtcagctgccatgccgcattcctccagcgccaagttgagtcgtggggacagcttgaaggagccaacctcaattgcagagagcagccgtcaccccagctaccgctcagagcccagcttggaaccagagagcttccgttctcctacctttggcaaaagttttcacttcgatccactatccagtggctcacgctcctccagcctcaagtcagcccagggcacaggctttgagctgggccagttgcaatccattcgttcagagggcaccacctccacctcctataagagcctggccaaccagacacgcaatggaagcctatcttatgacagcttgctcacaccttcagacagccctgattttgagtcagtgcaggcagggcctgagccagacccacctttaggctatacctctcccttcctgtcagccaggctggcccagcaacgggaagctgagaggcacccacgtttggtgccaactggcccaacacaccgagagccctcaccagtccgttacgacaatctgtcgcgccacattgtggcctctctccaggaacgagagaagttgctgcgccagtcacccccactcccgggccgtgaggaagaaccaggcttgggggactcaggcattcagtcaacaccaggctcgggccatgcccctcgtactagttcctcctcagatgattcaaagagatcacctttgggcaagactccactgggacgcccagctgtcccccgttttggcaagccagatgggctaaggggccggggagtagggtcccctgaaccaggcccaacagccccatacctgggccgatcgatgtcttacagcagccaaaaagcccaacctggtgtctctgagacagaagaagtggccttgcagccattactgacacccaaagatgaagtacagctgaagaccacctacagcaaatccaacgggcagcccaagagcttaggctcagcctcccctggcccaggccagccacctctcagtagccccacgaggggaggagtcaagaaggtgtcaggggttggtggtaccacctatgagatttcggtgtgagccttcggcacctcccctccccaacgcctctgcgcctacaccaaagggccccaggtggccaccttccttccctcaaggggctcccctcccgtgcatggacattttttaaaccaccgattccaagaggatgaggagtgttttctaaaatgcagtaggcttggggagtcggagagttggggccctgagactggggtagcaacccccccttttatcttttaagaccttcccttccttgatccctggaccagactcagtggacatttgtgcaattgctcgccctggagggaaccagatcatttttaaaccagaaataattttttttattattgtta

SEQ ID NO: 204478 - DNA, 440 bp, Homo sapiens
  Payload ID: 20333
  Gene Name: zinc finger, DHHC-type containing 5
  ENST ID: ENST00000532842
  CDS Start-End: 132-440
tgcagccgccatcttcctagtgggagctacgacactcttctttgcctttacctgaggaggatgaggacaaggaagatgatttccgagctcccctttacaaaacagtggagataaagggcatccaggtgcgcatgaaatggtgtgccacctgccgcttttaccgtccccctcgatgttcccactgcagtgtctgtgacaactgtgtggaggaatttgatcatcactgcccctgggtgaataactgtattggtcgccggaactaccgttattttttccttttcctcctttccctgacagcccacattatgggtgtgtttggctttggcctcctttatgtcctctaccacatagaggaactctcaggggtccgcacggctgtcacaatggcagtaatgtgtgtggctggcttattcttcatccctgtagctggcctcacggga

SEQ ID NO: 204479 - DNA, 901 bp, Homo sapiens
  Payload ID: 20333
  Gene Name: zinc finger, DHHC-type containing 5
  ENST ID: ENST00000529447
  CDS Start-End: 1-901
cgagctgaggaggatgaggacaaggaagatgatttccgagctcccctttacaaaacagtggagataaagggcatccaggtgcgcatgaaatggtgtgccacctgccgcttttaccgtccccctcgatgttcccactgcagtgtctgtgacaactgtgtggaggttacgggtaaattccggggaggtgtgaaccccttcaccaatggctgctgtaacaatgtcagccgtgttctctgcagttctccagcacccaggtatttggggagaccaaagaaagagaagacaattgtaatcagacctcccttccttcgaccagaagtttcagatgggcagataactgtgaagatcatggataatggcatccagggagagctgaggagaacaaagtctaagggaagcctggagataacagagagccagtctgcagatgctgaacctccacctcctcctaagccagacctgagccgttacacagggttgcgaacacacctcggcttggctactaatgaggatagtagcttattggccaaggacagccccccgacacctaccatgtacaagtatcggccgggttacagtagcagcagtacgtcagctgccatgccgcattcctccagcgccaagttgagtcgtggggacagcttgaaggagccaacctcaattgcagagagcagccgtcaccccagctaccgctcagagcccagcttggaaccagagagcttccgttctcctacctttggcaaaagttttcacttcgatccactatccagtggctcacgctcctccagcctcaagtcagcccagggcacaggctttgagctgggccagttgcaatccattcgttcagagggcaccacctccacctcctataagagcctggccaaccagacacgcaatggaa

SEQ ID NO: 204480 - DNA, 1721 bp, Homo sapiens
  Payload ID: 20334
  Gene Name: zinc finger, DHHC-type containing 6
  Uniprot ID: Q9H6R6
  ENST ID: ENST00000369404
  CDS Start-End: 412-1641
gggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggataccatgtatctccagtattgtaaagtctgccaagcatacaaggcaccacgttcacatcactgcagaaagtgtaacagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcggctctcctttgggtggaacacagtgaagatcgacatgagtgcagcccggagagatcctcttccaattgttccatttggattagctgcatttgctaccaccttgtttgccttgggattagctttaggaacaaccatagctgttgggatgttgttttttatccagatgaaaataattctcagaaacaaaacttctattgagtcatggattgaagagaaggctaaagatcgaattcagtattatcaactagatgaagtctttgtttttccatatgatatgggaagtagatggaggaactttaaacaggtatttacgtggtcaggggtccctgaaggagatggacttgagtggccagtaagagaaggctgtcaccaatacagcttaacaatagaacagttgaaacaaaaagcagataagagagtcagaagtgttcgctataaagtaatagaagattatagtggtgcctgctgccctctgaataaaggaatcaaaaccttcttcacaagtccctgcaccgaagagcctcgaatacagctgcaaaaaggggaattcattttagccacaagaggtttacgatactggttatatggagacaaaattcttgatgattcctttatagaaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatga

SEQ ID NO: 204481 - DNA, 2170 bp, Homo sapiens
  Payload ID: 20334
  Gene Name: zinc finger, DHHC-type containing 6
  Uniprot ID: Q9H6R6
  ENST ID: ENST00000369405
  CDS Start-End: 425-1666
agagtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagcatacaaggcaccacgttcacatcactgcagaaagtgtaacagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcggctctcctttgggtggaacacagtgaagatcgacatgagtgcagcccggagagatcctcttccaattgttccatttggattagctgcatttgctaccaccttgtttgccttgggattagctttaggaacaaccatagctgttgggatgttgttttttatccagatgaaaataattctcagaaacaaaacttctattgagtcatggattgaagagaaggctaaagatcgaattcagtattatcaactagatgaagtctttgtttttccatatgatatgggaagtagatggaggaactttaaacaggtatttacgtggtcaggggtccctgaaggagatggacttgagtggccagtaagagaaggctgtcaccaatacagcttaacaatagaacagttgaaacaaaaagcagataagagagtcagaagtgttcgctataaagtaatagaagattatagtggtgcctgctgccctctgaataaaggaatcaaaaccttcttcacaagtccctgcaccgaagagcctcgaatacagctgcaaaaaggggaattcattttagccacaagaggtttacgatactggttatatggagacaaaattcttgatgattcctttatagaaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatgagcctactctggttaagatgttcttttcctcaaaggtgccctagtgccatgatttaaatatttttattaccattttgaaatggagaagccattctgcatatgcctttgaattcctgcccctctttaccacctcttcctccccctcaaaggaaaaacatttcatccaagtaagttaacggcattttctgtaggattttcttatgcactgcacactctggacctcacctgcagatacagttccccccttgccaggagcatctgcatgtggtacttctcttttccctcagttgatatttcttatatgatattctagatactatagaactcaatttgtcagattcagtataacctcagattttgttacctgtcttttaaaaatgcagattttgtcaaatcaaataaagatcaatggatgttgggtataa

SEQ ID NO: 204482 - DNA, 2906 bp, Homo sapiens
  Payload ID: 20334
  Gene Name: zinc finger, DHHC-type containing 6
  ENST ID: ENST00000626395
  CDS Start-End: 546-1697
gggagagtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggtgggagtcaaggcagggaatataagcacgattttggtggtctttgtcccaccagagtgggagcaggctctcctgaatgttgagaccaacctggcttaccaggatatttcttccttgggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagcatacaaggcaccacgttcacatcactgcagaaagtgtaacagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcggctctcctttgggtggaacacagtgaagatcgacatgagtgcagcccggagagatcctcttccaattgttccatttggattagctgcatttgctaccaccttgtttgccttgggattagctttaggaacaaccatagctgttgggatgttgttttttatccagatgaaaataattctcagaaacaaaacttctattgagtcatggattgaagagaaggctaaagatcgaattcagtattatcaactagatgaagtctttgtttttccatatgatatgggaagtagatggaggaactttaaacaggtatttacgtggtcaggggtccctgaaggagatggacttgagtggccagtaagagaaggctgtcaccaatacagcttaacaatagaacagttgaaacaaaaagcagataagagagtcagaagtgttcgctataaagtaatagaagattatagtggtgcctgctgccctctgaataaaggaatcaaaaccttcttcacaagtccctgcaccgaagagcctcgaatacagctgcaaaaaggggaattcattttagccacaagaggtttacgatactggttatatggagacaaaattcttgatgattcctttatagaaggggtccttgtttaagactgattttcatcatggtccatgaggaaagaaacaccacaacttttataagcttggatcttctcattctgaacccaactatacaaatttcctgtagctacaagaaccagcatggtttgtgactgaaatgggctattgttaaaatgatatattacccgtaagctctccccgtgtacaaaaatttgtaacactggttgactcctgttgtagatattttctatcttctctggtgcaatgtattctccttgggccagcttgaaaatgttctttttacggtcgatgatcttcagagttccattctacatgagacagataaaagtatcagtatttttgagccacagagatgatatcagtggggagagtggtgaagtcacagtcatctttcttctctaaagctgatttctccagagacttttgagctgtctttcatttctctttcttggctttggtgaaaggggagggaagcatcgtgcagcaagaacctgtctttactgtatatctatgtggagagtcaatgcgcagccttagagaaagtctcctggatctactggagttatgcaaattgatgcctcatccaaggaagaaattgcacagctctcaatttccaatcactaatttccaattagttcattttcagaactctcagaaatagaggtgttgtcttttgtttagacttttgatttgatttgaatagttctcccaccacttgactccctgttatgttttcctccttgttagatccgggagcaggctcaaacagctccactgtgctaatcaagcaactcaattactgggcttgttaggacagcaacagggctgagaggactctgaccagccaccaaaggtcatttgcagcttcatttctctgaactaattggtctgaggagcttaggtctttagggatttgaattgtagaattgggacaaatggcaaataaaatccacatgctaacaccctaagtagggcgactaactaaaccaacactggaactatcacaaggccgacttgataaattagccatcaattcagcctaacgttcattatctgaaagtgattaataaggtgcagccttctataaccctggtgtggggacatatctgttgcttacatcctaggcttattagagtgttatttaattctgttactagacagaaacaaatatattagcaagatactaccaaacccaaatcaataaaatgcatcgttagg

SEQ ID NO: 204483 - DNA, 3442 bp, Homo sapiens
  Payload ID: 20335
  Gene Name: zinc finger, DHHC-type containing 7
  Uniprot ID: Q9NXF8
  ENST ID: ENST00000313732
  CDS Start-End: 354-1280
acttccggcgctcgcaccgccccgctctccagccaaggctccgggctgaggcatttgcttggctgcagcctccttccgacctgcccggcgggacccaggggaccaagccgagccgagccgcggggcccgctccagcccggccatgagcgcggccgcatgatgcgtccctgcctcggccgctgcagtcgccgccgccgccgccgcaggccgggaggagccgcagcgccgggcgaccccgcccgggcctcggatccgatcacataggacagtatgcaccttaagatcctgaagaaacggcacaaaatgttcaagtgatgtttagaaataacttgtgagggtgcgtcagggaaatcatgcagccatcaggacacaggctccgggacgtcgagcatcatcctctcctggctgaaaatgacaactatgactcttcatcgtcctcctcctccgaggctgacgtggctgaccgggtctggttcatccgtgacggctgcggcatgatctgtgctgtcatgacgtggcttctggtcgcctatgcagacttcgtggtgactttcgtcatgctgctgccttccaaagacttctggtactctgtggtcaacggggtcatctttaactgcttggccgtgcttgccctgtcatcccacctgagaaccatgctcaccgaccctggggcagtacccaaaggaaacgctacgaaagaatacatggagagcttgcagctgaagcccggggaagtcatctacaagtgccccaagtgctgctgtattaaacccgagcgcgcccaccactgcagtatttgcaaaagatgtattcggaaaatggatcatcactgcccgtgggtgaacaattgtgtaggagaaaagaatcaaagattttttgtgctcttcactatgtatatagctctgtcttcagtccatgctctgatcctttgtggatttcagttcatctcctgtgtccgagggcagtggactgaatgcagtgatttttcacctccgataactgtaatcctgttgatcttcctgtgccttgagggtcttctgtttttcactttcactgcagttatgtttggcacccaaatccactccatatgcaacgacgagacggagatcgagcgattgaaaagtgagaagcccacatgggagcggaggctgcgatgggaagggatgaagtccgtctttggggggcccccctcactcctctggatgaatccctttgtgggcttccgatttaggcgactgcccacgagacccagaaaaggtggcccggagttctcagtgtgaggcgtggctcatcagactgaaacttgctcacagacttccagttatttatttggggtctgaaggatatcaacagctcatctgtgaccaacagggcaactggaacctacacaaaccaattgcttgcagcaagcagagttttatatatttatagtcacagatggcagaggaagaggctctcagtccccacctgtacaacaacggaaaggtgtgtggccacacgaagaagccaaacgccgtggcctcctgcagagctggggcttctgtggagaatacttcgggttattacatgggttattcaaatcctgggtcctgagctgctgtttccaatcatgaagaaaaacagtgaatccagtgaacagggattctccaagcagtcatttcagggggctcctgctgaccccgccactcagcagtgcactccccggatcacagcagggcgtttacatagaaagacgttttggtctcgattagctccgatgctttgcactgaagttgcaaaagatctgtgcactgaacagtgaaggtggcttccggcacactccccgctgccccggaagagacatcctttgaccctctcagcaagtctgtgtgtgtgcgtgtctgtgcgtgtgcgcgcgtgtgtgcatgtgtgtcaaaattgccagtgttgtttaggcaatgtaacatttaccggctgtgtacagcaaacaagctattttttagaaaccgacgtttcagggaagaggggagagagccgcggggtcctgcccgtggttactatgaatgtattgctgttggaggacatctcgatccaaagaacagccgttcctgtgcggcccttcgttgccctcctgctttcattttttaaagaaatcttgagtgcttgagggccttggaactgattttttttttttgttccagccaaattagcagtgtataaatggcacctaggtaagagcagagctgcggctcggtgacttgatacttggggcagcccgatgctgtgtgtggggcaggggaggcatccttactggagaggcagggcccagccattgggcacctctgggaaggggaggggaccatgaggcagccagcccctggcaggggcgactgtgccaccgcaggcagcgctccagtcgggaatggccaggatggcgccctcttgttggagtttttggttagcttttacgttttcttctccacccacggcacaggtgataaaataggatccttggtgcggagcttaaaattatgccagaaagccaacagctcccctcgtggggccttgccttaaacttgcctggtttgtacattttttgccggacgcatcaagaagcaatctgtgacaaagtctgagggtcttcctttatgcttgccctccacactaagagaagttggcgtctccctcctgggaattgttttgcctttctgttcatctgtgaactgttttttgtttttaattactctgtaccccatccgaatcagggcttctaccactgctgatgcaaaaccacaaagggacctacctgagccaccgtcctagccaagcgagcaaacctgcagggggtttggaagtggacttggtcaccgcagaagcgtgtgcgccgttgggggaagagctgcgtcacagccagagggacaaagtgtgggtgatcctggagacgccagtttccgagattgttctgcatattcatttgcacattgttgtctgggttggacatgcgtgtgggcttcagtgtgaggcttttaatatgtatatcctgttatcaataaaacaattatccaagtggttgaatcctgtgagacttggcaagtgtgtgcaaatcaagtatacttgacttttcaacctcttctttcaatgtaacttttatatgaaataaagtaatcaattaacagttctcaaatggcttccaaagcgcccgttcttcctggatggtggtgttttcagggggtgcctttccgtgcttcgtgggcccagccccaggctgttaaggtcactcccaaacagtttccagaaactctaaatgcttttgtgcccatgacaagtgacctgggcactcaagcgcgactcacaaatgttgcccagtgagtactgttgcttgttgaatgtttaattcgactcccatcgttttacttagtcctttttttagtgcacgttgaaataaaaacaatgtttcaaaatc

SEQ ID NO: 204484 - DNA, 2727 bp, Homo sapiens
  Payload ID: 20335
  Gene Name: zinc finger, DHHC-type containing 7
  Uniprot ID: Q9NXF8
  ENST ID: ENST00000344861
  CDS Start-End: 341-1378
gcaccgccccgctctccagccaaggctccgggctgaggcatttgcttggctgcagcctccttccgacctgcccggcgggacccaggggaccaagccgagccgagccgcggggcccgctccagcccggccatgagcgcggccgcatgatgcgtccctgcctcggccgctgcagtcgccgccgccgccgccgcaggccgggaggagccgcagcgccgggcgaccccgcccgggcctcggatccgatcacataggacagtatgcaccttaagatcctgaagaaacggcacaaaatgttcaagtgatgtttagaaataacttgtgagggtgcgtcagggaaatcatgcagccatcaggacacaggctccgggacgtcgagcatcatcctctcctggctgaaaatgacaactatgactcttcatcgtcctcctcctccgaggctgacgtggctgaccgggtctggttcatccgtgacggctgcggcatgatctgtgctgtcatgacgtggcttctggtcgcctatgcagacttcgtggtgactttcgtcatgctgctgccttccaaagacttctggtactctgtggtcaacggggtcatctttaactgcttggccgtgcttgccctgtcatcccacctgagaaccatgctcaccgaccctgaaaaatccagtgactgccgaccatctgcctgcacagtgaaaactgggctggacccaacccttgtgggcatttgtggtgagggaaccgagtctgtgcaaagcctcctgcttggggcagtacccaaaggaaacgctacgaaagaatacatggagagcttgcagctgaagcccggggaagtcatctacaagtgccccaagtgctgctgtattaaacccgagcgcgcccaccactgcagtatttgcaaaagatgtattcggaaaatggatcatcactgcccgtgggtgaacaattgtgtaggagaaaagaatcaaagattttttgtgctcttcactatgtatatagctctgtcttcagtccatgctctgatcctttgtggatttcagttcatctcctgtgtccgagggcagtggactgaatgcagtgatttttcacctccgataactgtaatcctgttgatcttcctgtgccttgagggtcttctgtttttcactttcactgcagttatgtttggcacccaaatccactccatatgcaacgacgagacggagatcgagcgattgaaaagtgagaagcccacatgggagcggaggctgcgatgggaagggatgaagtccgtctttggggggcccccctcactcctctggatgaatccctttgtgggcttccgatttaggcgactgcccacgagacccagaaaaggtggcccggagttctcagtgtgaggcgtggctcatcagactgaaacttgctcacagacttccagttatttatttggggtctgaaggatatcaacagctcatctgtgaccaacagggcaactggaacctacacaaaccaattgcttgcagcaagcagagttttatatatttatagtcacagatggcagaggaagaggctctcagtccccacctgtacaacaacggaaaggtgtgtggccacacgaagaagccaaacgccgtggcctcctgcagagctggggcttctgtggagaatacttcgggttattacatgggttattcaaatcctgggtcctgagctgctgtttccaatcatgaagaaaaacagtgaatccagtgaacagggattctccaagcagtcatttcagggggctcctgctgaccccgccactcagcagtgcactccccggatcacagcagggcgtttacatagaaagacgttttggtctcgattagctccgatgctttgcactgaagttgcaaaagatctgtgcactgaacagtgaaggtggcttccggcacactccccgctgccccggaagagacatcctttgaccctctcagcaagtctgtgtgtgtgcgtgtctgtgcgtgtgcgcgcgtgtgtgcatgtgtgtcaaaattgccagtgttgtttaggcaatgtaacatttaccggctgtgtacagcaaacaagctattttttagaaaccgacgtttcagggaagaggggagagagccgcggggtcctgcccgtggttactatgaatgtattgctgttggaggacatctcgatccaaagaacagccgttcctgtgcggcccttcgttgccctcctgctttcattttttaaagaaatcttgagtgcttgagggccttggaactgattttttttttttgttccagccaaattagcagtgtataaatggcacctagggcttctaccactgctgatgcaaaaccacaaagggacctacctgagccaccgtcctagccaagcgagcaaacctgcagggggtttggaagtggacttggtcaccgcagaagcgtgtgcgccgttgggggaagagctgcgtcacagccagagggacaaagtgtgggtgatcctggagacgccagtttccgagattgttctgcatattcatttgcacattgttgtctgggttggacatgcgtgtgggcttcagtgtgaggcttttaatatgtatatcctgttatcaataaaacaattatccaagtggttgaatcctgtgagacttggcaagtgtgtgcaaatcaagtatacttgacttttcaacctcttctttcaatgtaacttttatatgaaataaagtaatcaattaacagttctcaaa

SEQ ID NO: 204485 - DNA, 483 bp, Homo sapiens
  Payload ID: 20335
  Gene Name: zinc finger, DHHC-type containing 7
  ENST ID: ENST00000569017
  CDS Start-End: 198-483
aagcattccttggaggccacctcatctggcctgcgtgctctagtgaggtcccgcgcacatgttttctggacctgaagttgtgacttgcctacagatccgatcacataggacagtatgcaccttaagatcctgaagaaacggcacaaaatgttcaagtgatgtttagaaataacttgtgagggtgcgtcagggaaatcatgcagccatcaggacacaggctccgggacgtcgagcatcatcctctcctggctgaaaatgacaactatgactcttcatcgtcctcctcctccgaggctgacgtggctgaccgggtctggttcatccgtgacggctgcggcatgatctgtgctgtcatgacgtggcttctggtcgcctatgcagacttcgtggtgactttcgtcatgctgctgccttccaaagacttctggtactctgtggtcaacggggtcatctttaactgcttggccgtgcttgccctgtcat

SEQ ID NO: 204486 - DNA, 582 bp, Homo sapiens
  Payload ID: 20335
  Gene Name: zinc finger, DHHC-type containing 7
  ENST ID: ENST00000566909
  CDS Start-End: 160-582
ccccgtgatccacccgcctcagcctcccaaagtgctgggattacaggtgtgacccactgcgcccggcctgatgtttttaactttcattctccccaactaaagtacattcttcttatatggtagggggcagtacccaaaggaaacgctacgaaagaatacatggagagcttgcagctgaagcccggggaagtcatctacaagtgccccaagtgctgctgtattaaacccgagcgcgcccaccactgcagtatttgcaaaagatgtattcggaaaatggatcatcactgcccgtgggtgaacaattgtgtaggagaaaagaatcaaagattttttgtgctcttcactatgtatatagctctgtcttcagtccatgctctgatcctttgtggatttcagttcatctcctgtgtccgagggcagtggactgaatgcagtgatttttcacctccgataactgtaatcctgttgatcttcctgtgccttgagggtcttctgtttttcactttcactgcagttatgtttggcacccaaatccactccatatgcaacgacgagacggagatcgagcgattgaaaagtgag

SEQ ID NO: 204487 - DNA, 1488 bp, Homo sapiens
  Payload ID: 20335
  Gene Name: zinc finger, DHHC-type containing 7
  Uniprot ID: Q9NXF8
  ENST ID: ENST00000564466
  CDS Start-End: 321-1358
caaggctccgggctgaggcatttgcttggctgcagcctccttccgacctgcccggcgggacccaggggaccaagccgagccgagccgcggggcccgctccagcccggccatgagcgcggccgcatgatgcgtccctgcctcggccgctgcagtcgccgccgccgccgccgcaggccgggaggagccgcagcgccgggcgaccccgcccgggcctcggatccgatcacataggacagtatgcaccttaagatcctgaagaaacggcacaaaatgttcaagtgatgtttagaaataacttgtgagggtgcgtcagggaaatcatgcagccatcaggacacaggctccgggacgtcgagcatcatcctctcctggctgaaaatgacaactatgactcttcatcgtcctcctcctccgaggctgacgtggctgaccgggtctggttcatccgtgacggctgcggcatgatctgtgctgtcatgacgtggcttctggtcgcctatgcagacttcgtggtgactttcgtcatgctgctgccttccaaagacttctggtactctgtggtcaacggggtcatctttaactgcttggccgtgcttgccctgtcatcccacctgagaaccatgctcaccgaccctgaaaaatccagtgactgccgaccatctgcctgcacagtgaaaactgggctggacccaacccttgtgggcatttgtggtgagggaaccgagtctgtgcaaagcctcctgcttggggcagtacccaaaggaaacgctacgaaagaatacatggagagcttgcagctgaagcccggggaagtcatctacaagtgccccaagtgctgctgtattaaacccgagcgcgcccaccactgcagtatttgcaaaagatgtattcggaaaatggatcatcactgcccgtgggtgaacaattgtgtaggagaaaagaatcaaagattttttgtgctcttcactatgtatatagctctgtcttcagtccatgctctgatcctttgtggatttcagttcatctcctgtgtccgagggcagtggactgaatgcagtgatttttcacctccgataactgtaatcctgttgatcttcctgtgccttgagggtcttctgtttttcactttcactgcagttatgtttggcacccaaatccactccatatgcaacgacgagacggagatcgagcgattgaaaagtgagaagcccacatgggagcggaggctgcgatgggaagggatgaagtccgtctttggggggcccccctcactcctctggatgaatccctttgtgggcttccgatttaggcgactgcccacgagacccagaaaaggtggcccggagttctcagtgtgaggcgtggctcatcagactgaaacttgctcacagacttccagttatttatttggggtctgaaggatatcaacagctcatctgtgaccaacagggcaactggaacctacacaaaccaattgcttgcagcaag

SEQ ID NO: 204488 - DNA, 3072 bp, Homo sapiens
  Payload ID: 20336
  Gene Name: zinc finger, DHHC-type containing 8
  Uniprot ID: Q9ULC8
  ENST ID: ENST00000320602
  CDS Start-End: 1-2022
atgccccgcagccccgggacgcgcctcaaacccgccaagtacatcccggtggccacggccgccgcgctgctggtcggctccagcaccctcttcttcgtgttcacgtgcccgtggttgacacgagctgtgtccccagctgttcccgtctacaatggcatcatcttcctctttgtcctggccaacttcagcatggccactttcatggaccctggtgttttcccccgagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggtgactgggaagttccgcgggggtgtgaaccctttcacccgaggctgctgtgggaatgtggagcacgtgctgtgtagccccctggcgccccggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaagtccaagggcagcctggaccggctggatgagaagccactggacttggggccaccactgccccccaagatagaggctggcacgttcagcagtgacctgcagaccccgcgcccaggcagtgctgagagtgccctgtcggtgcagaggaccagccccccgacacctgccatgtacaagtttaggccggctttccccacgggtcccaaggtgcccttctgtggaccaggcgagcaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaacgccccggggccccggcccagcagtggctcacacaggtcacctgcacgccagggcctgccctccccgcccggcactccccactcaccatcctacgcgggccccaaagctgtcgccttcatccacacggacctcccagagccaccgccctcgctgaccgtgcagagggaccaccctcagctgaagactcccccaagtaagcttaatgggcagtccccgggcctggcccggctgggacctgccaccggccccccagggccctctgccagccctacacggcacacgctggttaagaaggtgtccggcgtgggtgggaccacctacgagatctcggtgtgaggactgactgccacacatccgccatggtgccacggggaccaggaccccacagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccctttcatcaaagccttaacctttgctttatgctcttgtgggaggcgacgggggggcaggcgggagcaggcacgggggtgatgctgccacagggggctggtgacacccagagccccctccccagccctcaggccctccctgccaaactggagaaccccaccccaaggcatgccacgtccgcagccccggcctggctgcggtgctcgcgccgtgggaaagcacactggggaggggtcagtgcttcccttggtgtcagggacctgagagtaagcacatgacagcgtctgcttgcgttgtgtctgttttatgtttttatatctacatctatatatctataattttattaaaaaaaagaaaaag

SEQ ID NO: 204489 - DNA, 5046 bp, Homo sapiens
  Payload ID: 20336
  Gene Name: zinc finger, DHHC-type containing 8
  Uniprot ID: Q9ULC8
  ENST ID: ENST00000334554
  CDS Start-End: 142-2439
gggtgggatttcctccgccgccgccgccgccgccgccgcgggtcctgcgccgcgtccagcccgcccgcccgaccccggcccgaccccggccggccctgcccgcccggccccggggagggatgcggcggcgcggcgcccaggatgccccgcagccccgggacgcgcctcaaacccgccaagtacatcccggtggccacggccgccgcgctgctggtcggctccagcaccctcttcttcgtgttcacgtgcccgtggttgacacgagctgtgtccccagctgttcccgtctacaatggcatcatcttcctctttgtcctggccaacttcagcatggccactttcatggaccctggtgttttcccccgagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggactttgaccaccactgcccctgggtcaacaactgcatcgggcgtcgaaactatcgctacttcttcctgttcctgctgtcactcagtgcacacatggtgggcgtcgtggccttcggcctggtctacgtgctgaaccacgctgaggggctgggagccgcgcacaccaccatcaccatggctgtcatgtgtgtggccggcctcttcttcatccctgtcattggcctcactggcttccatgtggtgctggtcactcgggggcgcaccaccaacgagcaggtgactgggaagttccgcgggggtgtgaaccctttcacccgaggctgctgtgggaatgtggagcacgtgctgtgtagccccctggcgccccggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaagtccaagggcagcctggaccggctggatgagaagccactggacttggggccaccactgccccccaagatagaggctggcacgttcagcagtgacctgcagaccccgcgcccaggcagtgctgagagtgccctgtcggtgcagaggaccagccccccgacacctgccatgtacaagtttaggccggctttccccacgggtcccaaggtgcccttctgtggaccaggcgagcaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaacgccccggggccccggcccagcagtggctcacacaggtcacctgcacgccagggcctgccctccccgcccggcactccccactcaccatcctacgcgggccccaaagctgtcgccttcatccacacggacctcccagagccaccgccctcgctgaccgtgcagagggaccaccctcagctgaagactcccccaagtaagcttaatgggcagtccccgggcctggcccggctgggacctgccaccggccccccagggccctctgccagccctacacggcacacgctggttaagaaggtgtccggcgtgggtgggaccacctacgagatctcggtgtgaggactgactgccacacatccgccatggtgccacggggaccaggaccccacagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccctttcatcaaagccttaacctttgctttatgctcttgtgggaggcgacgggggggcaggcgggagcaggcacgggggtgatgctgccacagggggctggtgacacccagagccccctccccagccctcaggccctccctgccaaactggagaaccccaccccaaggcatgccacgtccgcagccccggcctggctgcggtgctcgcgccgtgggaaagcacactggggaggggtcagtgcttcccttggtgtcagggacctgagagtaagcacatgacagcgtctgcttgcgttgtgtctgttttatgtttttatatctacatctatatatctataattttattaaaaaaaagaaaaagagttattttgattctttccttgggcaaggccagggctattgctgcaggatcccgagttaggggagggcaggggccgggccccagaagagggagtggctgctgtctggtgtgcaggggtcggtgggttcctcaggggcatttctgccgacttgggctgagtcagaggcttgggaagagggggcggccgatggtctgtggctgggaagtgtgagggtctctcgccttgggtctgtgtcagttctggcagtgacagggtgtttgggggaaagacttgggtctgccgctacccacaggggactctcaggaacccgagagcttggggagatgaaatgggggtgcataggggccacctgttggctcagggccctgtgggggccgctgaacctgctggaactctcctgcctgccacatgccaggggcagggctgagggagtgtgagggatgcacagctgttcagggctgagacattctgggctggggctgtcccagcgtgggaggcgtgcgggctgtagggccccgaagctgacctccacctttctgcttctctctcacggacgccgcggcccgcagggggcggattggcacctgcacccgtggatgggggcggcgtggccagccttgggtgcctcctgggctgcacctgtgccaccttggccgcccggaggaccgcccaccactgcgggccccctggagccaggccgccggggcacccccacgcggggccatgtgccgcctgcacttggctgcctccagtcttttccccagcctctcggggccctagcaggatgacaagtaggcggctctggggcccaggacagcccagctggggacccaggaggtcagactgcagtggaccctggggcagggctgggggtgggctgggctctctgctccaccagccacagcttgacagattcccagcctgccagggcctgagaccctgtgtccacatgacctcagggagtcccccacctgctgcagggggtccagcaccccacaggggggcagtcccagagctgtggggaccggcacgacctttgcccagcctccctacccaaccaagcactttagactaagccacttcctcctcggggagcccaggcctccgtgggttgggctgggtggggggggggtctcaggttgcccctgaaggtctctgcactcctcctgcccttcccctgacacatgaacagatgccttaacttcctggagccaccagcctggtgagccattggcctctgcctgccaccaaggtcctgtggtcttggccagctccgcctgggccccactggggctgcctgcacccagagacgatgccggcgggatctcagagggcctgaggcccaagccctgtgtcctccagcagtggtacggcctgcggcagggtggcactccggccagcccttctccgtcacagggtccctgtccctgggtccaccctgggctgtggctctacatctcccatttggggacgagaaagccacaaaaccattctctattgttcttaagggtacccctgctaattaattccccaaataaaatttttggtgttgatca

SEQ ID NO: 204490 - DNA, 3112 bp, Homo sapiens
  Payload ID: 20336
  Gene Name: zinc finger, DHHC-type containing 8
  Uniprot ID: Q9ULC8
  ENST ID: ENST00000405930
  CDS Start-End: 1-2337
atgccccgcagccccgggacgcgcctcaaacccgccaagtacatcccggtggccacggccgccgcgctgctggtcggctccagcaccctcttcttcgtgttcacgtgcccgtggttgacacgagctgtgtccccagctgttcccgtctacaatggcatcatcttcctctttgtcctggccaacttcagcatggccactttcatggaccctggtgttttcccccgagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggactttgaccaccactgcccctgggtcaacaactgcatcgggcgtcgaaactatcgctacttcttcctgttcctgctgtcactcagtgcacacatggtgggcgtcgtggccttcggcctggtctacgtgctgaaccacgctgaggggctgggagccgcgcacaccaccatcaccatggctgtcatgtgtgtggccggcctcttcttcatccctgtcattggcctcactggcttccatgtggtgctggtcactcgggggcgcaccaccaacgagcaggtgactgggaagttccgcgggggtgtgaaccctttcacccgaggctgctgtgggaatgtggagcacgtgctgtgtagccccctggcgccccggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaagtccaagggcagcctggaccggctggatgagaagccactggacttggggccaccactgccccccaagatagaggctggcacgttcagcagtgacctgcagaccccgcgcccaggcagtgctgagagtgccctgtcggtgcagaggaccagccccccgacacctgccatgtacaagtttaggccggctttccccacgggtcccaaggtgcccttctgtggaccaggcgagcaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaacgccccggggccccggcccagcagtggctcacacaggtcacctgcacgccagggcctgccctccccgcccggcactccccactcaccatcctacgcgggccccaaagctgtcgccttcatccacacggacctcccagagccaccgccctcgctgaccgtgcagagggggcggattggcacctgcacccgtggatgggggcggcgtggccagccttgggtgcctcctgggctgcacctgtgccaccttggccgcccggaggaccgcccaccactgcgggccccctggagccaggccgccggggcacccccacgcggggccatgtgccgcctgcacttggctgcctccagtcttttccccagcctctcggggccctagcaggatgacaagtaggcggctctggggcccaggacagcccagctggggacccaggaggtcagactgcagtggaccctggggcagggctgggggtgggctgggctctctgctccaccagccacagcttgacagattcccagcctgccagggcctgagaccctgtgtccacatgacctcagggagtcccccacctgctgcagggggtccagcaccccacaggggggcagtcccagagctgtggggaccggcacgacctttgcccagcctccctacccaaccaagcactttagactaagccacttcctcctcggggagcccaggcctccgtgggttgggctgggtggggggggggtctcaggttgcccctgaaggtctctgcactcctcctgcccttcccctgacacatgaacagatgccttaacttcctggagccaccagcctggtgagccattggcctctgcctgccaccaaggtcctgtggtcttggccagctccgcctgggccccactggggctgcctgcacccagagacgatgccggcgggatctcagagggcctgaggcccaagccctgtgtcctccagcagtggtacggcctgcggcagggtggcactccggccagcccttctccgtcacagggtccctgtccctgggtccaccctgggctgtggctctacatctcccatttggggacgagaaagccacaaaaccattctctattgttcttaagggtacccctgctaattaattccccaaataaaatttttggtgttgatc

SEQ ID NO: 204491 - DNA, 557 bp, Homo sapiens
  Payload ID: 20336
  Gene Name: zinc finger, DHHC-type containing 8
  ENST ID: ENST00000436518
  CDS Start-End: 17-557
gacactgcaggatgcgatggtgctgcgggaagggagctgtgctgggagacagaatgcgtccgcgtgctggccccacgggaccacagggtgcccgtggttgacacgagctgtgtccccagctgttcccgtctacaatggcatcatcttcctctttgtcctggccaacttcagcatggccactttcatggaccctggtgttttcccccgagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggactttgaccaccactgcccctgggtcaacaactgcatcgggcgtcgaaactatcgctacttcttcctgttcctgctgtcactcagtgcacacatggtgggcgtcgtggccttcggcctggtctacgtgctgaaccacgctgaggggctgggagccgcgcacaccaccatcacgtatccttggttcctgt

SEQ ID NO: 204492 - DNA, 4569 bp, Homo sapiens
  Payload ID: 20337
  Gene Name: zinc finger, DHHC-type containing 9
  Uniprot ID: Q9Y397
  ENST ID: ENST00000357166
  CDS Start-End: 393-1487
atttggccagtggtgggcggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtggttcaggccggctcccccttcctggtctcccttctcccgctgggccggtttatcgggaggagattgtcttccagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaatgctaaccagttcttccattaagcctcggctgagtgagggaaagcccagcactgctgccctctcgggtaactcaccctaaggcctcggcccacctctggctatggtaaccacactgggggcttcctccaagccccgctcttccagcacttccaccggcagagtcccagagccacttcaccctgggggtgggctgtggcccccagtcagctctgctcaggacctgctctatttcagggaagaagatttatgtattatatgtggctatatttcctagagcacctgtgttttcctctttctaagccagggtcctgtctggatgacttatgcggtgggggagtgtaaaccagaacttttcatctatttgaaggcgattaaactgtgtctaatgcaaacttcctgcctcctccttcccccttccatttcaagaatatgtttgtgtgtagggtgggggtgggggttggaaggggttgcttgttactccccaaacttccattaaccagggcacccttgggttggagaggtagttccaaactctccattgatctatactacattctgggctgaaggttttcttattctggactatgaagaaaggactttcaaggagatatagtgtgaacaggatcaggaaggtagagggattatatttacttaagagaacaagctctatattaggatattgttttgaagcagatggatgccgttaattgctaataagtcttagttattaacgcaggctcatcagggcccccccttggaaatatttgatcagtggtcttttacaagtgatggtatatatttctttctaggtggtgtataatcaagactccctatcaattcccatctcatacttcccagttaattggaattaatgaaatttggctgctcccagacctttttccatgtcttcctttttccttttaacaggatttaagttgagcattcttgagagagagagagagagagagattggaagagagatggggagagactgactcagatccctctcctgtctgcttctttttctggttctctcagttttttttcttgaagttataaagccaaacctggagaatttgtaagttgttaggtttccccaggtaacttggcactcatatgaaccccattttaataagtactcagcccatctcctctcctgggctcagatggctctctctcctccctcaccttacctcaagtgttctcctgaggacccttaggtcagacagagaagctttctctttctgatgggaagggtcaaagtggaaatctcttatctctagtgtgaaatgattttctgctttttcatactccctgccctctttcttttccttaataaatcttccatgtttaagatgttggcctgaagatctgtcccattcataccatgcaccagctgggactgtccctatctgatcagaggggagattaaagaatcaatgttcccaggggaaaagggccttaaattgtttggtcttttcaatggctgacactgtctccaactctccccttcctccttcttcctcaagcttcctatgcaccctactttcccaggccaggatggttggcactgatcccaaacctctgggggcaggtggaaattggctgtggtgagccatttcttcatgtccattcagctctgaggccttcctggccctagctgagatcatcatctcctcctttgcttttaccccaggagtgaggttgggttagaggtggattctgattccgtagcagctaaattccattctccctgtcctgaccatcctgcctttacccataaagcacccgttcctactgaccaaatctctttactttgttggagaaaaaaagtattttgtttttaaatctattttctaatttaaatgcaatttaatatgtaaatctctgcacttttgtgtgagcctacaaatgtgtatgtgttgggggtttttcactctctggtatttcttaataaagaaatctttcttttggggggaagccaattaatgaaggagccttgaatggttttagaaatacagggctgtctgtttctttgtg

SEQ ID NO: 204493 - DNA, 2473 bp, Homo sapiens
  Payload ID: 20337
  Gene Name: zinc finger, DHHC-type containing 9
  Uniprot ID: Q9Y397
  ENST ID: ENST00000371064
  CDS Start-End: 338-1432
ggcgtggcggagtcagggcgggcctcgagaggccgcgcccgcggctcggccccggactccggcctccggcctccggccccccgctggggagccggtcgctgcttcccgacggattttgatctttgttcttccaggccggctcccccttcctggtctcccttctcccgctgggccggtttatcgggaggagattgtcttccagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaa

SEQ ID NO: 204494 - DNA, 737 bp, Homo sapiens
  Payload ID: 20337
  Gene Name: zinc finger, DHHC-type containing 9
  ENST ID: ENST00000406492
  CDS Start-End: 226-737
gacctggtgacgtgaggagcgttccatttggccagtggtgggcggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtggttcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctg

SEQ ID NO: 204495 - DNA, 581 bp, Homo sapiens
  Payload ID: 20337
  Gene Name: zinc finger, DHHC-type containing 9
  ENST ID: ENST00000433917
  CDS Start-End: 1-581
cccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtg

SEQ ID NO: 204496 - DNA, 4362 bp, Homo sapiens
  Payload ID: 20338
  Gene Name: zinc finger, FYVE domain containing 1
  Uniprot ID: Q9HBF4
  ENST ID: ENST00000318876
  CDS Start-End: 641-2932
tgttagtccgagctgggagaagttcactccgatcagctgatcccaactgacaacaggagaggaggaagcccgggaggcaacgaaggaggagggtggcggagatggagatgaggatggatctgccggtgtcctgaggaatagcctctgcccccactggcgccctgcggccccccgacgccgccttgctgcggccgagcttctcagtggtatcccctgaaatactgacttcaggtcgaattatattgaaaagctcctgaccactttctttcattaccaaaactttgtagctgatgtccaaccgatgaacccaccaccgtgaacccatcagacctctctcagatagccataaaagacccttccaagtcaattttgaccacatctttgcttgcactttatggaggatgaaaccatcaaaccaaatcaacgttgctgctaatacaagagtcttagaggcagcaaattaaaaatttgaacatttgtttgtgaagaactataacaggacatgaaaggtgttcttttttaaagtgttcagaaccctgtggaagtttcgtgcagtcttcagactcaaatcttcgtcttcacccccggggcaagctcagtgactattatatggtgggtgtgtttccttaccagcgtgagtatgagtgcccagacttccccagcagagaagggcctgaatccggggctgatgtgccaggaaagttacgcttgcagcgggactgatgaagctatctttgagtgtgatgagtgctgcagtctgcagtgtctccgctgcgaggaggagctccatcggcaggagcgcctgagaaaccatgagcggataagactcaaacctggccatgtcccttactgtgacctctgcaagggtctcagtgggcatttaccaggtgttaggcagagggcaatagtgaggtgccagacctgcaaaattaacttgtgcctggagtgccagaagaggactcattctgggggtaacaaaaggagacaccctgttactgtgtacaatgtcagtaatctccaggagtcactggaggcagaagagatggatgaggagaccaagaggaagaagatgactgagaaggttgtgagtttcctcctagtagacgaaaatgaagaaattcaggtaacaaatgaagaagactttattagaaaattggactgcaaacctgatcagcatctgaaagtggtttccatttttggaaatactggtgatggaaagtctcatactctcaaccacactttcttttatggtcgtgaagtctttaaaacctccccgacccaggagtcctgcactgtgggagtgtgggcagcctatgacccagttcacaaagtagcagtgatcgatacggaagggctcctgggggccaccgtgaatctaagccagagaacacggctgctgcttaaggtcctggccatctcagacctcgtcatctatcgaactcatgcagaccggctgcataacgacctcttcaaattccttggggatgcctcagaagcttatctgaagcacttcaccaaggagctcaaggccaccactgctcgctgtggcctggatgtccctttatccacactgggccctgcagttatcatcttccatgagaccgtgcacacccagctactgggctctgatcatccctcagaggtgccagagaagctcatccaggaccggttccggaagctgggccgtttccctgaagcctttagttccattcactacaagggaacgaggacttacaaccctcccacggacttttctgggcttcggcgtgctttggagcagctactagagaataacaccacccgttctccccggcacccgggagtcatcttcaaagccctgaaggcactaagtgaccgcttcagcggtgagatccccgatgaccagatggcgcacagctccttttttccagatgagtatttcacctgctcctccttgtgcctcagctgtggggttggatgtaagaaaagcatgaatcatgggaaggaaggagtgcctcatgaagccaagagccgctgcagatactcccaccagtatgacaaccgagtgtatacctgcaaggcctgctatgagagaggcgaggaagtcagtgtagtgcccaaaacatctgcttccactgactccccctggatgggtctcgcaaaatatgcctggtctggtcggcagtactggtttggaaaccaagatcctgtggatacggtggtgcggacagagattgtgcatgtgtggcctggaactgatgggtttctgaaggacaacaacaatgctgcccagcgcctgttggacgggatgaacttcatggctcagtcggtgtccgagcttagccttggacccaccaaggctgtgacttcctggctgacagaccagatcgcccctgcctactggaggcccaactcccagattctgagctgcaacaagtgtgcgacgtcctttaaagataacgacactaagcatcactgccgagcctgtggggagggcttctgtgacagctgttcatcaaagactcggccagtgcctgagcggggctggggccctgcgccagtgcgggtctgtgacaactgctacgaagccaggaacgtccagttagctgttaccgaggcacaagtggacgatgaaggtggaacgctcattgctcggaaggtgggcgaggccgtgcagaacactctgggagccgtggtgacagccattgacataccactaggtctggtaaaggacgcggccaggcctgcgtactgggtgcctgaccacgaaatcctccactgccacaactgccggaaggagttcagcatcaagctctccaagcaccactgccgggcctgcggacagggcttctgtgatgagtgctcccatgaccgccgggctgttccttctcgtggctgggaccatcccgtccgagtctgcttcaactgcaataaaaagcccggtgacctttaaccccagccccctctccgagtccttcacaattccttaggttctcagggttagaaacagtcttgcgaggtaggccctcctcccagtcacctgctgtggtgtgtgtcctctcctctccgcatccagggccactttccctcagtgggggtgagcctggcggcaggcccgaaggtgtggacccctcagggcaggggaccttgcaacttatcgcaaaggggaatgaacctgaatccgttgcatttatttcagttaaaaataatgaatatatatgtgtatatctctctctcatatatacatatgaaaggcactcggggcgtatcgaggctgctgctggctgtgaagacttcgcacagtctcctccgcacagggtgaggtggcagtggcagcacgtcttcctcatgagccgagccaggtccatggccaccacgtggctggccccttcctctgctgctcttggagccttggaagcctctcctgtccttggctcttccctccatgcctgtcagctgcctggggagtgagcctccctggtccttcctgcctgaaacagcctgaagggaattctccctaggtctcctgggagtcgagtcccaattcttggcttaagcctgttttagtcagagaccacccaacttagcgtgcaggtcaccggagtgggtggagggtcagaggtcgggtcttcggccctgagaagtagaaatgcaggggccgtgctgtccctggtcccccagggaacagcaaggaaggaactgagccttctccagcagggcttcctgtcccgatgcttctgtctccactcggctttcccaaaaggcggcacccagctcctcaatcgaagcatctgcctcccacccctcggccccctcaagcccaccatctgcttctgagtgtcgcactaggattttcattgcttattttaaagtgtcttaatcctttgttcccagacacacaacccctctagctctcggaggggcgatcatgagaaaccttccagggaaactgagcacaggatgaactgttagttgtttttaaaagtctatataaatatttcaacagatcgtaaagaaaaaatttatctctttggtccttgcaagagaagtcaaaggaacttttgtttctcctcaagagcctggacatctctgtctgtcatgactggaaagggcccgttgtgctgaaatcctatcatcatggtggatttgatcttcagtggccaaacacgaattaaagtataattcttaactgaactggtgggtgggttgagctttagggaagtatatggcggtcattcctggtgcgcctatcggtgtgacatgagccctggagtgtgtcgtccctctcagccctgctcctcctgcctcctggggtccagtgactgggaccctactctagaactgtgtaccatccaattcgccatcataaaggaatcttcctgc

SEQ ID NO: 204497 - DNA, 1183 bp, Homo sapiens
  Payload ID: 20338
  Gene Name: zinc finger, FYVE domain containing 1
  Uniprot ID: Q9HBF4
  ENST ID: ENST00000394207
  CDS Start-End: 91-1179
agctttgggatctcaggaggaggagaacccaagaaactgtggaatgatgcactaagtgaccgcttcagcggtgagatccccgatgaccagatggcgcacagctccttttttccagatgagtatttcacctgctcctccttgtgcctcagctgtggggttggatgtaagaaaagcatgaatcatgggaaggaaggagtgcctcatgaagccaagagccgctgcagatactcccaccagtatgacaaccgagtgtatacctgcaaggcctgctatgagagaggcgaggaagtcagtgtagtgcccaaaacatctgcttccactgactccccctggatgggtctcgcaaaatatgcctggtctgggtatgtgatcgaatgtcctaactgtggcgtggtctatcgtagtcggcagtactggtttggaaaccaagatcctgtggatacggtggtgcggacagagattgtgcatgtgtggcctggaactgatgggtttctgaaggacaacaacaatgctgcccagcgcctgttggacgggatgaacttcatggctcagtcggtgtccgagcttagccttggacccaccaaggctgtgacttcctggctgacagaccagatcgcccctgcctactggaggcccaactcccagattctgagctgcaacaagtgtgcgacgtcctttaaagataacgacactaagcatcactgccgagcctgtggggagggcttctgtgacagctgttcatcaaagactcggccagtgcctgagcggggctggggccctgcgccagtgcgggtctgtgacaactgctacgaagccaggaacgtccagttagctgttaccgaggcacaagtggacgatgaaggtggaacgctcattgctcggaaggtgggcgaggccgtgcagaacactctgggagccgtggtgacagccattgacataccactaggtctggtaaaggacgcggccaggcctgcgtactgggtgcctgaccacgaaatcctccactgccacaactgccggaaggagttcagcatcaagctctccaagcaccactgccgggcctgcggacagggcttctgtgatgagtgctcccatgaccgccgggctgttccttctcgtggctgggaccatcccgtccgagtctgcttcaactgcaataaaaagcccggtgacctttaacccc

SEQ ID NO: 204498 - DNA, 4485 bp, Homo sapiens
  Payload ID: 20338
  Gene Name: zinc finger, FYVE domain containing 1
  Uniprot ID: Q9HBF4
  ENST ID: ENST00000556143
  CDS Start-End: 722-3055
agtgcgcactacgcccttgctggcgccgggatcctccctctctcgctcctccctttctgggctgcaccgctcacgccttcctgttagtccgagctgggagaagttcactccgatcagctgatcccaactgacaacaggagaggaggaagcccgggaggcaacgaaggaggagggtggcggagatggagatgaggatggatctgccggtgtcctgaggaatagcctctgcccccactggcgccctgcggccccccgacgccgccttgctgcggccgagcttctcagtggtatcccctgaaatactgacttcaggtcgaattatattgaaaagctcctgaccactttctttcattaccaaaactttgtagctgatgtccaaccgatgaacccaccaccgtgaacccatcagacctctctcagatagccataaaagacccttccaagtcaattttgaccacatctttgcttgcactttatggaggatgaaaccatcaaaccaaatcaacgttgctgctaatacaagagtcttagaggcagcaaattaaaaatttgaacatttgtttgtgaagaactataacaggacatgaaaggtgttcttttttaaagtgttcagaaccctgtggaagtttcgtgcagtcttcagactcaaatcttcgtcttcacccccggggcaagctcagtgactattatatggtgggtgtgtttccttaccagcgtgagtatgagtgcccagacttccccagcagagaagggcctgaatccggggctgatgtgccaggaaagttacgcttgcagcgggactgatgaagctatctttgagtgtgatgagtgctgcagtctgcagtgtctccgctgcgaggaggagctccatcggcaggagcgcctgagaaaccatgagcggataagactcaaacctggccatgtcccttactgtgacctctgcaagggtctcagtgggcatttaccaggtgttaggcagagggcaatagtgaggtgccagacctgcaaaattaacttgtgcctggagtgccagaagaggactcattctgggggtaacaaaaggagacaccctgttactgtgtacaatgtcagtaatctccaggagtcactggaggcagaagagatggatgaggagaccaagaggaagaagatgactgagaaggttgtgagtttcctcctagtagacgaaaatgaagaaattcaggtaacaaatgaagaagactttattagaaaattggactgcaaacctgatcagcatctgaaagtggtttccatttttggaaatactggtgatggaaagtctcatactctcaaccacactttcttttatggtcgtgaagtctttaaaacctccccgacccaggagtcctgcactgtgggagtgtgggcagcctatgacccagttcacaaagtagcagtgatcgatacggaagggctcctgggggccaccgtgaatctaagccagagaacacggctgctgcttaaggtcctggccatctcagacctcgtcatctatcgaactcatgcagaccggctgcataacgacctcttcaaattccttggggatgcctcagaagcttatctgaagcacttcaccaaggagctcaaggccaccactgctcgctgtggcctggatgtccctttatccacactgggccctgcagttatcatcttccatgagaccgtgcacacccagctactgggctctgatcatccctcagaggtgccagagaagctcatccaggaccggttccggaagctgggccgtttccctgaagcctttagttccattcactacaagggaacgaggacttacaaccctcccacggacttttctgggcttcggcgtgctttggagcagctactagagaataacaccacccgttctccccggcacccgggagtcatcttcaaagccctgaaggcactaagtgaccgcttcagcggtgagatccccgatgaccagatggcgcacagctccttttttccagatgagtatttcacctgctcctccttgtgcctcagctgtggggttggatgtaagaaaagcatgaatcatgggaaggaaggagtgcctcatgaagccaagagccgctgcagatactcccaccagtatgacaaccgagtgtatacctgcaaggcctgctatgagagaggcgaggaagtcagtgtagtgcccaaaacatctgcttccactgactccccctggatgggtctcgcaaaatatgcctggtctgggtatgtgatcgaatgtcctaactgtggcgtggtctatcgtagtcggcagtactggtttggaaaccaagatcctgtggatacggtggtgcggacagagattgtgcatgtgtggcctggaactgatgggtttctgaaggacaacaacaatgctgcccagcgcctgttggacgggatgaacttcatggctcagtcggtgtccgagcttagccttggacccaccaaggctgtgacttcctggctgacagaccagatcgcccctgcctactggaggcccaactcccagattctgagctgcaacaagtgtgcgacgtcctttaaagataacgacactaagcatcactgccgagcctgtggggagggcttctgtgacagctgttcatcaaagactcggccagtgcctgagcggggctggggccctgcgccagtgcgggtctgtgacaactgctacgaagccaggaacgtccagttagctgttaccgaggcacaagtggacgatgaaggtggaacgctcattgctcggaaggtgggcgaggccgtgcagaacactctgggagccgtggtgacagccattgacataccactaggtctggtaaaggacgcggccaggcctgcgtactgggtgcctgaccacgaaatcctccactgccacaactgccggaaggagttcagcatcaagctctccaagcaccactgccgggcctgcggacagggcttctgtgatgagtgctcccatgaccgccgggctgttccttctcgtggctgggaccatcccgtccgagtctgcttcaactgcaataaaaagcccggtgacctttaaccccagccccctctccgagtccttcacaattccttaggttctcagggttagaaacagtcttgcgaggtaggccctcctcccagtcacctgctgtggtgtgtgtcctctcctctccgcatccagggccactttccctcagtgggggtgagcctggcggcaggcccgaaggtgtggacccctcagggcaggggaccttgcaacttatcgcaaaggggaatgaacctgaatccgttgcatttatttcagttaaaaataatgaatatatatgtgtatatctctctctcatatatacatatgaaaggcactcggggcgtatcgaggctgctgctggctgtgaagacttcgcacagtctcctccgcacagggtgaggtggcagtggcagcacgtcttcctcatgagccgagccaggtccatggccaccacgtggctggccccttcctctgctgctcttggagccttggaagcctctcctgtccttggctcttccctccatgcctgtcagctgcctggggagtgagcctccctggtccttcctgcctgaaacagcctgaagggaattctccctaggtctcctgggagtcgagtcccaattcttggcttaagcctgttttagtcagagaccacccaacttagcgtgcaggtcaccggagtgggtggagggtcagaggtcgggtcttcggccctgagaagtagaaatgcaggggccgtgctgtccctggtcccccagggaacagcaaggaaggaactgagccttctccagcagggcttcctgtcccgatgcttctgtctccactcggctttcccaaaaggcggcacccagctcctcaatcgaagcatctgcctcccacccctcggccccctcaagcccaccatctgcttctgagtgtcgcactaggattttcattgcttattttaaagtgtcttaatcctttgttcccagacacacaacccctctagctctcggaggggcgatcatgagaaaccttccagggaaactgagcacaggatgaactgttagttgtttttaaaagtctatataaatatttcaacagatcgtaaagaaaaaatttatctctttggtccttgcaagagaagtcaaaggaacttttgtttctcctcaagagcctggacatctctgtctgtcatgactggaaagggcccgttgtgctgaaatcctatcatcatggtggatttgatcttcagtggccaaacacgaattaaagtataattcttaactgaactggtgggtgggttgagctttagggaagtatatggcggtcattcctggtgcgcctatcggtgtgacatgagccctggagtgtgtcgtccctctcagccctgctcctcctgcctcctggggtccagtgactgggaccctactctagaactgtgtaccatccaattcgccatcataaaggaatcttcctgc

SEQ ID NO: 204499 - DNA, 1225 bp, Homo sapiens
  Payload ID: 20338
  Gene Name: zinc finger, FYVE domain containing 1
  Uniprot ID: Q9HBF4
  ENST ID: ENST00000555072
  CDS Start-End: 137-1225
ctttcttggggtaggtgggcccttccctgcctttctcttctagctttgggatctcaggaggaggagaacccaagaaactgtggaatgatgtgaggcactaagtgaccgcttcagcggtgagatccccgatgaccagatggcgcacagctccttttttccagatgagtatttcacctgctcctccttgtgcctcagctgtggggttggatgtaagaaaagcatgaatcatgggaaggaaggagtgcctcatgaagccaagagccgctgcagatactcccaccagtatgacaaccgagtgtatacctgcaaggcctgctatgagagaggcgaggaagtcagtgtagtgcccaaaacatctgcttccactgactccccctggatgggtctcgcaaaatatgcctggtctgggtatgtgatcgaatgtcctaactgtggcgtggtctatcgtagtcggcagtactggtttggaaaccaagatcctgtggatacggtggtgcggacagagattgtgcatgtgtggcctggaactgatgggtttctgaaggacaacaacaatgctgcccagcgcctgttggacgggatgaacttcatggctcagtcggtgtccgagcttagccttggacccaccaaggctgtgacttcctggctgacagaccagatcgcccctgcctactggaggcccaactcccagattctgagctgcaacaagtgtgcgacgtcctttaaagataacgacactaagcatcactgccgagcctgtggggagggcttctgtgacagctgttcatcaaagactcggccagtgcctgagcggggctggggccctgcgccagtgcgggtctgtgacaactgctacgaagccaggaacgtccagttagctgttaccgaggcacaagtggacgatgaaggtggaacgctcattgctcggaaggtgggcgaggccgtgcagaacactctgggagccgtggtgacagccattgacataccactaggtctggtaaaggacgcggccaggcctgcgtactgggtgcctgaccacgaaatcctccactgccacaactgccggaaggagttcagcatcaagctctccaagcaccactgccgggcctgcggacagggcttctgtgatgagtgctcccatgaccgccgggctgttccttctcgtggctgggaccatcccgtccgagtctgcttcaactgcaataaaaagcccggtgacctttaa

SEQ ID NO: 204500 - DNA, 3244 bp, Homo sapiens
  Payload ID: 20338
  Gene Name: zinc finger, FYVE domain containing 1
  ENST ID: ENST00000553891
  CDS Start-End: 616-2985
actccgatcagctgatcccaactgacaacaggagaggaggaagcccgggaggcaacgaaggaggagggtggcggagatggagatgaggatggatctgccggtgtcctgaggaatagcctctgcccccactggcgccctgcggccccccgacgccgccttgctgcggccgagcttctcagtggtatcccctgaaatactgacttcaggtcgaattatattgaaaagctcctgaccactttctttcattaccaaaactttgtagctgatgtccaaccgatgaacccaccaccgtgaacccatcagacctctctcagatagccataaaagacccttccaagtcaattttgaccacatctttgcttgcactttatggaggatgaaaccatcaaaccaaatcaacgttgctgctaatacaagagtcttagaggcagcaaattaaaaatttgaacatttgtttgtgaagaactataacaggacatgaaaggtgttcttttttaaagtgttcagaaccctgtggaagtttcgtgcagtcttcagactcaaatcttcgtcttcacccccggggcaagctcagtgactattatatggtgggtgtgtttccttaccagcgtgagtatgagtgcccagacttccccagcagagaagggcctgaatccggggctgatgtgccaggaaagttacgcttgcagcgggactgatgaagctatctttgagtgtgatgagtgctgcagtctgcagtgtctccgctgcgaggaggagctccatcggcaggagcgcctgagaaaccatgagcggataagactcaaacctggccatgtcccttactgtgacctctgcaagggtctcagtgggcatttaccaggtgttaggcagagggcaatagtgaggtgccagacctgcaaaattaacttgtgcctggagtgccagaagaggactcattctgggggtaacaaaaggagacaccctgttactgtgtacaatgtcagtaatctccaggagtcactggaggcagaagagatggatgaggagaccaagaggaagaagatgactgagaaggttgtgagtttcctcctagtagacgaaaatgaagaaattcaggtaacaaatgaagaagactttattagaaaattggactgcaaacctgatcagcatctgaaagtggtttccatttttggaaatactggtgatggaaagtctcatactctcaaccacactttcttttatggtcgtgaagtctttaaaacctccccgacccaggagtcctgcactgtgggagtgtgggcagcctatgacccagttcacaaagtagcagtgatcgatacggaagggctcctgggggccaccgtgaatctaagccagagaacacggctgctgcttaaggtcctggccatctcagacctcgtcatctatcgaactcatgcagaccggctgcataacgacctcttcaaattccttggggatgcctcagaagcttatctgaagcacttcaccaaggagctcaaggccaccactgctcgctgtggcctggatgtccctttatccacactgggccctgcagttatcatcttccatgagaccgtgcacacccagctactgggctctgatcatccctcagaggtgccagagaagctcatccaggaccggttccggaagctgggccgtttccctgaagcctttagttccattcactacaagggaacgaggacttacaaccctcccacggacttttctgggcttcggcgtgctttggagcagctactagagaataacaccacccgttctccccggcacccgggagtcatcttcaaagccctgaaggcactaagtgaccgcttcagcggtgagatccccgatgaccagatggcgcacagctccttttttccagatgagtatttcacctgctcctccttgtgcctcagctgtggggttggatgtaagaaaagcatgaatcatgggaaggaaggagtgcctcatgaagccaagagccgctgcagatactcccaccagtatgacaaccgagtgtatacctgcaaggcctgctatgagagaggcgaggaagtcagtgtagtgcccaaaacatctgcttccactgactccccctggatgggtctcgcaaaatatgcctggtctgggtatgtgatcgaatgtcctaactgtggcgtggtctatcgtagtcggcagtactggtttggaaaccaagatcctgtggatacggtggtgcggacagagattgtgcatgtgtggcctggaactgatgggtttctgaaggacaacaacaatgctgcccagcgcctgttggacgggatgaacttcatggctcagtcggtgtccgagcttagccttggacccaccaaggctgtgacttcctggctgacagaccagatcgcccctgcctactggaggcccaactcccagattctgagctgcaacaagtgtgcgacgtcctttaaagataacgacactaagcatcactgccgagcctgtggggagggcttctgtgacagctgttcatcaaagactcggccagtgcctgagcggggctggggccctgcgccagtgcgggtctgtgacaactgctacgaagccaggaacgtccagttagctgttaccgaggcacaagtggacgatgaaggtggaacgctcattgctcggaaggtgggcgaggccgtgcagaacactctgggagccgtggtgacagccattgacataccactaggtctggtaaaggacgcggccaggcctgcgtactgggtgcctgaccacgaaatcctccactgccacaactgccggaaggagttcagcatcaagctctccaagcaccactgccgggcctgcggacagggcttctgtgatgagtgctcccatgaccgccgggctgttccttctcgtggctgggaccatcccgtccgagtctgcttcaactgcaataaaaagcccgcctggacatctctgtctgtcatgactggaaagggcccgttgtgctgaaatcctatcatcatggtggatttgatcttcagtggccaaacacgaattaaagtataattcttaactgaactggtgggtgggttgagctttagggaagtatatggcggtcattcctggtgcgcctatcggtgtgacatgagccctggagtgtgtcgtccctctcagccctgctcctcctgcctcctggggtccagtgactgggaccctactctagaactgtgtaccatccaattcgccatcataaaggaatcttcctgca

SEQ ID NO: 204501 - DNA, 6773 bp, Homo sapiens
  Payload ID: 20339
  Gene Name: zinc finger, FYVE domain containing 16
  Uniprot ID: Q7Z3T8
  ENST ID: ENST00000338008
  CDS Start-End: 181-4800
ctctgcgctgcccggtggggcggggaaagaagccctgagccgggatctggcactcccaggactcccggccggggtagctcttcactcctcagcgcgacgtcgtgtcgagttcccaaaaagctccgcaggggctgtagggaggcatacaagaattaaattctgaataagtctgcaggtaggatggacagttattttaaagcagctgtcagtgacttggacaaactccttgatgattttgaacagaacccagatgaacaagattatctccaagatgtacaaaatgcatatgattctaaccactgctcagtttcttcagagttggcttcctcacagcgaacttcattgctcccaaaagaccaagagtgcgttaatagttgtgcctcatcagaaacaagctatggaacaaatgagagttccctgaatgaaaaaacactcaagggacttacttctatacaaaatgaaaaaaatgtaacaggacttgatcttctttcttctgtggatggtggtacttcagatgaaatccagccgttatatatgggacgatgtagtaaacctatctgtgatctgataagtgacatgggtaacttagttcatgcaaccaatagtgaagaagatattaaaaaattattgccagatgattttaagtctaatgcagattccttgattggattggatttatcttcagtgtcagatactccctgtgtttcttcaacagaccatgatagtgatactgtcagagaacaacagaatgatatcagttctgaattacaaaatagagaaatcggaggaatcaaagaattgggtataaaagtagatacaacactttcagattcctataattacagtggaacagaaaatttaaaagataaaaagatctttaatcagttagaatcaattgttgattttaacatgtcatctgctttgactcgacaaagttccaaaatgtttcatgccaaagacaagctacaacacaagagccagccatgtggattactaaaagatgttggcttagtaaaagaggaagtagatgtggcagtcataactgccgcagaatgtttaaaagaagagggcaagacaagtgctttgacctgcagccttccgaaaaatgaagatttatgcttaaatgattcaaattcaagagatgaaaatttcaaattacctgacttttcctttcaggaagataagactgttataaaacaatctgcacaagaagactcaaaaagtttagaccttaaggataatgatgtaatccaagattcctcttcagctttacatgtttccagtaaagatgtgccgtcctcattgtcctgtcttcctgcgtctgggtctatgtgtggatcattaattgaaagtaaagcacggggtgattttttacctcagcatgaacataaagataatatacaagatgcagtgactatacatgaagaaatacagaacagtgttgttctaggtggggaaccattcaaagagaatgatcttttgaaacaggaaaaatgtaaaagcatactccttcagtcattaattgaagggatggaagacagaaagatagatcctgaccagacagtaatcagagctgagtctttggatggtggtgacaccagttctacagttgtagaatctcaagaggggctttctggcactcatgtcccagagtcttctgattgttgtgaaggttttattaatactttttcaagcaatgatatggatgggcaagacttagattactttaatattgatgaaggcgcaaaaagtggcccactaattagtgatgctgaacttgatgcctttctgacagaacagtatcttcagaccactaacataaagtcttttgaagaaaatgtaaatgactctaaatcgcaaatgaatcagatagatatgaaaggcttagatgatggaaacatcaataatatatatttcaatgcagaagcaggagctattggggaaagtcatggtattaatataatttgtgaaatagttgataaacaaaatacaatagaaaatggcctttctttaggagaaaaaagcactattccagttcaacaagggttacctaccagtaagtctgagattacaaatcaattatcggtctctgatattaacagtcaatctgttggaggggccagacctaagcaattgtttagccttccatcaagaacaaggagttcaaaggacctgaataagccagatgttccagatacaatagaaagtgaacccagcacagcagataccgttgttccaatcacttgtgctatagattctacagctgatccacaggttagcttcaactctaattacattgatatagaaagtaattctgaaggtggatctagtttcgtaactgcaaatgaagattctgtacctgaaaacacttgcaaagaaggcttggttttgggccagaaacagcctacttgggttcctgattcagaagctccaaactgtatgaactgccaagtcaaatttacttttaccaaacggcgacaccattgccgagcatgtgggaaagtattttgtggtgtctgttgtaataggaagtgtaaactgcaatatctagaaaaggaagcaagagtatgtgtagtctgctatgaaactattagtaaagctcaggcatttgaaaggatgatgagtccaactggttctaatcttaagtctaatcattctgatgaatgtactactgtccagcctcctcaggagaaccaaacatccagtataccttcaccagcaactttgccagtctcagcacttaaacaaccaggtgttgaaggactatgttccaaagaacagaagagagtatggtttgcagatggtatattgcccaatggtgaagttgcagatacaacaaaattatcatctggaagtaaaagatgttctgaagactttagtcctctctcacctgatgtgcctatgacagtaaacacagtggatcattcccattctactacagtggaaaagccaaacaatgagacaggagatattacaagaaatgagataattcagagtcctatttctcaggttccatcagtggaaaaattgtctatgaacacaggaaatgaggggttacctacttctggttcatttacactagatgatgatgtttttgcagaaactgaagaaccatctagtcctactggtgtcttagttaacagcaatttacctattgctagtatttcagattataggttactgtgtgatattaacaagtatgtctgcaataagattagtcttctacctaatgatgaggacagtttgcccccacttctggttgcatctggagaaaagggatcagtgcctgtagtagaagaacatccatctcatgagcagatcattttgcttcttgaaggtgaaagctttcatcctgttacatttgtcctaaatgctaatctactcgtgaatgtcaaattcatattttattcctcagacaaatattggtacttttcaaccaatggattgcatggcttgggacaggcagaaattattattctattgttatgtttgccaaatgaagatactattcctaaggacatcttcagactatttatcaccatatataaggatgctctaaaaggaaaatacatagaaaacttggacaatattacctttactgagagttttctcagtagcaaggatcacggaggattcctgtttattacacctacttttcagaaacttgatgatctctcattaccaagtaatccttttctttgtggaattcttatccagaagcttgagattccctgggcaaaggtttttcctatgcgtttaatgttgagattgggtgcagaatataaagcatatcctgctcctctaacaagcatcagaggccgaaaacctctttttggagaaataggacacactattatgaacttacttgttgaccttcgaaattaccagtataccttgcataatatagatcaactgttgattcatatggaaatgggaaaaagctgcataaaaataccacggaaaaagtacagtgatgtaatgaaagtactaaattcttccaatgagcatgtcattagcattggagcaagtttcagtacagaagcagattctcatctagtctgtatacagaatgatggaatttatgaaacacaggccaacagtgccactggccatcctagaaaagtgacaggtgcaagttttgtggtattcaatggagctctaaaaacatcttcaggatttcttgctaagtccagcatagttgaagatggcttaatggtacaaataactccagagaccatgaatggcttgcggctagctttacgagaacagaaagactttaaaattacatgtgggaaagttgatgcagtagacctgagagaatacgtggatatctgctgggtagatgctgaagaaaaaggaaacaaaggagttatcagttcagtggatggaatatcattacaaggatttccaagtgaaaaaataaaactggaagcagattttgaaaccgatgagaagattgtaaaatgtaccgaggtgttctactttctaaaggaccaggatttatctattttatcaacttcttatcagtttgcaaaagaaatagccatggcttgtagtgctgcgctgtgccctcacctgaaaactctaaaaagtaatgggatgaataaaattggactcagagtttccattgacactgatatggttgaatttcaggcaggatctgaaggccaacttctgcctcagcattatctaaatgatcttgatagtgctctgatacctgtgatccatggtgggacctccaactctagtttaccattagaaatagaattagtgtttttcattatagaacatcttttttagtgaaagaatgtgccatattacatattgcaacctaatttgttaaaactaactccagcactaaagctgaaatgccacaaacactaaaagtataaatatgtctgatttttgaaacacataagctttgctctttaggcaggaatgatcttttcaaatcattagcacaatatttaaatatctaaaaatttaagagatccatactttctgtagctttacaattaatttaagtactaaaaagacaaggatttcttttaagaaatttatagcatttactgtgttatttaaatgctaagccaaagtatctgcacttaggtatacctctttatgccaataatgattttaatgaaggctcttttcagatgtaaccttatgaaggaaatatctgctttgtgtatatgccagttagaatactggtttctaaagtctgtcaaattgtatttcagtggcacaaaaaccagttttgaggtcttagacttataattctttgaataaaactgataacttatttgtataattggagtggagacctacctccataattagataaactctttttggattataatcagaattttgccttttttcttctcaaattattacatatgtatgtattatatatccacatatatagttttccctgattaaatggatattaaaataattgcgggtgcttcaggactttttgcttctatatttaagtatattgtttttatagcaagaacatattctgaatgttttataaatctttaataatttatatgtaggtaatatttttgtatcacaatgcattatttttttcctcctttccttccaaactataccactgtatttaccacttctaagagtgactgacgacgggccagatgacccttgaagtagtcattatgtagcaataaatgaagcctgaaacaggtttttttacttccactttaatccttagaaatttcttggcaacttcgcatattttcattgacaccagtgtataagtataaatttaaatgaactaattacttttgcatattttaaattctttatatggtagttattttttataacaggatattaacataagttaaatcctatgtatttgaaattgttacagagctttcctctttacttcaaacagcaaaaaagtggggggcatattgtagtcctgtcatttaagttatgtaaaaaatttaatcattattttgatgctttaaacattctcatgtgtaatatatgtttttgtatcaaaaacactcatatatttcaagaaaaagaaattatgttaaatagccctgttttaagaaaaatatttatgaagcatctcaacttgaagatcaagtcaaagttataactcaggatctgaggtctcaagctaggagagactgagaattttaatcagtttgggcatatagtttggactgaatcacatctgtagtacttagccaaagacaatttggaggagaatatcagccttctggaagtagctacttcctgaacaatgtaaagtgtcgcagatattcaataaaatggcaacctgttataatttgtgaaatttattgaaatggtgtaagatgaaaacaattgcatatcaaacccaatttatgttttctaaatatagtgtatgtattctgccatgtaagtaattgaacagtcttaaaataaccaaatggtagagggctgttccatgatgggacagctttggatttgttttcataaaatctctatattcaataaaaattggaattatgtgcctgaagtttggaggcacattttgaagtattctttgtagacatatagtatgtttctgaatgtgtttgttacttatttggtcattggtacttaatttgaaattttaattttttaagagaagaaatagaatggttctttgtactcagtctgcaatgatctatttttggcttatgtcttttaatactactctctttctctgaattttgaaatatgaagtaaaatctagcccatttgtttta

SEQ ID NO: 204502 - DNA, 308 bp, Homo sapiens
  Payload ID: 20339
  Gene Name: zinc finger, FYVE domain containing 16
  ENST ID: ENST00000507548
  CDS Start-End: 1-154
aggactatgttccaaagaacagaagagagtatggtttgcagatggtatattgcccaatggtgaagttgcagatacaacaaaattatcatctggaagtaaaagatgttctgaagactttagtcctctctcacctgatgtgcctatgtgcctgtagtagaagaacatccatctcatgagcagatcattttgcttcttgaaggtgaaagctttcatcctgttacatttgtcctaaatgctaatctactcgtgaatgtcaaattcatattttattcctcagacaaatattggtacttttcaaccaatggatt

SEQ ID NO: 204503 - DNA, 684 bp, Homo sapiens
  Payload ID: 20339
  Gene Name: zinc finger, FYVE domain containing 16
  ENST ID: ENST00000509562
  CDS Start-End: 565-684
cccggccggggtagctcttcactcctcagcgcgacgtcgtgtcgagttcccaaaaagctccgcaggggctgtagggaggcatacaagaattaaattctgaataagtctgcaggtaggatggacagttattttaaagcagctgtcagtgacttggacaaactccttgatgattttgaacagaacccagatggggtctcactgtgttgctcaggctggtcttgaactcctgatctcaagttatcctccgaccgtggcttcccaaagcgctgggattacagttatgaacaagattatctccaagatgtacaaaatgcatatgattctaaccactgctcagtttcttcagagttggcttcctcacagcgaacttcattgctcccaaaagaccaagagtgcgttaatagttgtgcctcatcagaaacaagctatggaacaaatgagagttccctgaatgaaaaaacactcaagggacttacttctatacaaaatgaaaaaaatgtaacaggacttgatcttctttcttctgtggatggtggtacttcagatgaaatccagccgttatatatgggacgatgtagtaaacctatctgtgatctgataagtgacatgggtaacttagttcatgcaaccaatagtgaagaagatattaaaaaattattgccagatgattttaagtctaatgca

SEQ ID NO: 204504 - DNA, 6680 bp, Homo sapiens
  Payload ID: 20339
  Gene Name: zinc finger, FYVE domain containing 16
  Uniprot ID: Q7Z3T8
  ENST ID: ENST00000510158
  CDS Start-End: 298-4917
ccggtggggcggggaaagaagccctgagccgggatctggcactcccaggactcccggccggggtagctcttcactcctcagcgcgacgtcgtgtcgagttcccaaaaagctccgcaggggctgtagggaggtgatctcatccattaacagctgtgtgttgccagttcccaaatctttatctatctcagacttctctcctgcattccagattcttatattcagctgccttttggatatctctcccaggatgttctcaaggcatacaagaattaaattctgaataagtctgcaggtaggatggacagttattttaaagcagctgtcagtgacttggacaaactccttgatgattttgaacagaacccagatgaacaagattatctccaagatgtacaaaatgcatatgattctaaccactgctcagtttcttcagagttggcttcctcacagcgaacttcattgctcccaaaagaccaagagtgcgttaatagttgtgcctcatcagaaacaagctatggaacaaatgagagttccctgaatgaaaaaacactcaagggacttacttctatacaaaatgaaaaaaatgtaacaggacttgatcttctttcttctgtggatggtggtacttcagatgaaatccagccgttatatatgggacgatgtagtaaacctatctgtgatctgataagtgacatgggtaacttagttcatgcaaccaatagtgaagaagatattaaaaaattattgccagatgattttaagtctaatgcagattccttgattggattggatttatcttcagtgtcagatactccctgtgtttcttcaacagaccatgatagtgatactgtcagagaacaacagaatgatatcagttctgaattacaaaatagagaaatcggaggaatcaaagaattgggtataaaagtagatacaacactttcagattcctataattacagtggaacagaaaatttaaaagataaaaagatctttaatcagttagaatcaattgttgattttaacatgtcatctgctttgactcgacaaagttccaaaatgtttcatgccaaagacaagctacaacacaagagccagccatgtggattactaaaagatgttggcttagtaaaagaggaagtagatgtggcagtcataactgccgcagaatgtttaaaagaagagggcaagacaagtgctttgacctgcagccttccgaaaaatgaagatttatgcttaaatgattcaaattcaagagatgaaaatttcaaattacctgacttttcctttcaggaagataagactgttataaaacaatctgcacaagaagactcaaaaagtttagaccttaaggataatgatgtaatccaagattcctcttcagctttacatgtttccagtaaagatgtgccgtcctcattgtcctgtcttcctgcgtctgggtctatgtgtggatcattaattgaaagtaaagcacggggtgattttttacctcagcatgaacataaagataatatacaagatgcagtgactatacatgaagaaatacagaacagtgttgttctaggtggggaaccattcaaagagaatgatcttttgaaacaggaaaaatgtaaaagcatactccttcagtcattaattgaagggatggaagacagaaagatagatcctgaccagacagtaatcagagctgagtctttggatggtggtgacaccagttctacagttgtagaatctcaagaggggctttctggcactcatgtcccagagtcttctgattgttgtgaaggttttattaatactttttcaagcaatgatatggatgggcaagacttagattactttaatattgatgaaggcgcaaaaagtggcccactaattagtgatgctgaacttgatgcctttctgacagaacagtatcttcagaccactaacataaagtcttttgaagaaaatgtaaatgactctaaatcgcaaatgaatcagatagatatgaaaggcttagatgatggaaacatcaataatatatatttcaatgcagaagcaggagctattggggaaagtcatggtattaatataatttgtgaaatagttgataaacaaaatacaatagaaaatggcctttctttaggagaaaaaagcactattccagttcaacaagggttacctaccagtaagtctgagattacaaatcaattatcggtctctgatattaacagtcaatctgttggaggggccagacctaagcaattgtttagccttccatcaagaacaaggagttcaaaggacctgaataagccagatgttccagatacaatagaaagtgaacccagcacagcagataccgttgttccaatcacttgtgctatagattctacagctgatccacaggttagcttcaactctaattacattgatatagaaagtaattctgaaggtggatctagtttcgtaactgcaaatgaagattctgtacctgaaaacacttgcaaagaaggcttggttttgggccagaaacagcctacttgggttcctgattcagaagctccaaactgtatgaactgccaagtcaaatttacttttaccaaacggcgacaccattgccgagcatgtgggaaagtattttgtggtgtctgttgtaataggaagtgtaaactgcaatatctagaaaaggaagcaagagtatgtgtagtctgctatgaaactattagtaaagctcaggcatttgaaaggatgatgagtccaactggttctaatcttaagtctaatcattctgatgaatgtactactgtccagcctcctcaggagaaccaaacatccagtataccttcaccagcaactttgccagtctcagcacttaaacaaccaggtgttgaaggactatgttccaaagaacagaagagagtatggtttgcagatggtatattgcccaatggtgaagttgcagatacaacaaaattatcatctggaagtaaaagatgttctgaagactttagtcctctctcacctgatgtgcctatgacagtaaacacagtggatcattcccattctactacagtggaaaagccaaacaatgagacaggagatattacaagaaatgagataattcagagtcctatttctcaggttccatcagtggaaaaattgtctatgaacacaggaaatgaggggttacctacttctggttcatttacactagatgatgatgtttttgcagaaactgaagaaccatctagtcctactggtgtcttagttaacagcaatttacctattgctagtatttcagattataggttactgtgtgatattaacaagtatgtctgcaataagattagtcttctacctaatgatgaggacagtttgcccccacttctggttgcatctggagaaaagggatcagtgcctgtagtagaagaacatccatctcatgagcagatcattttgcttcttgaaggtgaaagctttcatcctgttacatttgtcctaaatgctaatctactcgtgaatgtcaaattcatattttattcctcagacaaatattggtacttttcaaccaatggattgcatggcttgggacaggcagaaattattattctattgttatgtttgccaaatgaagatactattcctaaggacatcttcagactatttatcaccatatataaggatgctctaaaaggaaaatacatagaaaacttggacaatattacctttactgagagttttctcagtagcaaggatcacggaggattcctgtttattacacctacttttcagaaacttgatgatctctcattaccaagtaatccttttctttgtggaattcttatccagaagcttgagattccctgggcaaaggtttttcctatgcgtttaatgttgagattgggtgcagaatataaagcatatcctgctcctctaacaagcatcagaggccgaaaacctctttttggagaaataggacacactattatgaacttacttgttgaccttcgaaattaccagtataccttgcataatatagatcaactgttgattcatatggaaatgggaaaaagctgcataaaaataccacggaaaaagtacagtgatgtaatgaaagtactaaattcttccaatgagcatgtcattagcattggagcaagtttcagtacagaagcagattctcatctagtctgtatacagaatgatggaatttatgaaacacaggccaacagtgccactggccatcctagaaaagtgacaggtgcaagttttgtggtattcaatggagctctaaaaacatcttcaggatttcttgctaagtccagcatagttgaagatggcttaatggtacaaataactccagagaccatgaatggcttgcggctagctttacgagaacagaaagactttaaaattacatgtgggaaagttgatgcagtagacctgagagaatacgtggatatctgctgggtagatgctgaagaaaaaggaaacaaaggagttatcagttcagtggatggaatatcattacaaggatttccaagtgaaaaaataaaactggaagcagattttgaaaccgatgagaagattgtaaaatgtaccgaggtgttctactttctaaaggaccaggatttatctattttatcaacttcttatcagtttgcaaaagaaatagccatggcttgtagtgctgcgctgtgccctcacctgaaaactctaaaaagtaatgggatgaataaaattggactcagagtttccattgacactgatatggttgaatttcaggcaggatctgaaggccaacttctgcctcagcattatctaaatgatcttgatagtgctctgatacctgtgatccatggtgggacctccaactctagtttaccattagaaatagaattagtgtttttcattatagaacatcttttttagtgaaagaatgtgccatattacatattgcaacctaatttgttaaaactaactccagcactaaagctgaaatgccacaaacactaaaagtataaatatgtctgatttttgaaacacataagctttgctctttaggcaggaatgatcttttcaaatcattagcacaatatttaaatatctaaaaatttaagagatccatactttctgtagctttacaattaatttaagtactaaaaagacaaggatttcttttaagaaatttatagcatttactgtgttatttaaatgctaagccaaagtatctgcacttaggtatacctctttatgccaataatgattttaatgaaggctcttttcagatgtaaccttatgaaggaaatatctgctttgtgtatatgccagttagaatactggtttctaaagtctgtcaaattgtatttcagtggcacaaaaaccagttttgaggtcttagacttataattctttgaataaaactgataacttatttgtataattggagtggagacctacctccataattagataaactctttttggattataatcagaattttgccttttttcttctcaaattattacatatgtatgtattatatatccacatatatagttttccctgattaaatggatattaaaataattgcgggtgcttcaggactttttgcttctatatttaagtatattgtttttatagcaagaacatattctgaatgttttataaatctttaataatttatatgtaggtaatatttttgtatcacaatgcattatttttttcctcctttccttccaaactataccactgtatttaccacttctaagagtgactgacgacgggccagatgacccttgaagtagtcattatgtagcaataaatgaagcctgaaacaggtttttttacttccactttaatccttagaaatttcttggcaacttcgcatattttcattgacaccagtgtataagtataaatttaaatgaactaattacttttgcatattttaaattctttatatggtagttattttttataacaggatattaacataagttaaatcctatgtatttgaaattgttacagagctttcctctttacttcaaacagcaaaaaagtggggggcatattgtagtcctgtcatttaagttatgtaaaaaatttaatcattattttgatgctttaaacattctcatgtgtaatatatgtttttgtatcaaaaacactcatatatttcaagaaaaagaaattatgttaaatagccctgttttaagaaaaatatttatgaagcatctcaacttgaagatcaagtcaaagttataactcaggatctgaggtctcaagctaggagagactgagaattttaatcagtttgggcatatagtttggactgaatcacatctgtagtacttagccaaagacaatttggaggagaatatcagccttctggaagtagctacttcctgaacaatgtaaagtgtcgcagatattcaataaaatggcaacctgttataatttgtgaaatttattgaaatggtgtaagatgaaaacaattgcatatcaaacccaatttatgttttctaaatatagtgtatgtattctgccatgtaagtaattgaacagtcttaaaataaccaaatggtagagggctgttccatgatgggacagctttggatttgttttcataaaatctctatattcaataaaaattggaattatgtgcctgaagtttggaggcacattttgaagt

SEQ ID NO: 204505 - DNA, 423 bp, Homo sapiens
  Payload ID: 20339
  Gene Name: zinc finger, FYVE domain containing 16
  ENST ID: ENST00000513789
  CDS Start-End: 1-112
caatggagctctaaaaacatcttcaggatttcttgctaagtccagcatagttgaagagttatcagttcagtggatggaatatcattacaaggatttccaagtgaaaaaataaaactggaagcagattttgaaaccgatgagaagattgtaaaatgtaccgaggtgttctactttctaaaggaccaggatttatctattttatcaacttcttatcagtttgcaaaagaaatagccatggcttgtagtgctgcgctgtgccctcacctgaaaactctaaaaagtaatgggatgaataaaattggactcagagtttccattgacactgatatggttgaatttcaggcaggatctgaaggccaacttctgcctcagcattatctaaatgatcttgatagtgctctgatacctgtgatccatggtggg

SEQ ID NO: 204506 - DNA, 637 bp, Homo sapiens
  Payload ID: 20339
  Gene Name: zinc finger, FYVE domain containing 16
  ENST ID: ENST00000509558
  CDS Start-End: 1-156
actggttctaatcttaagtctaatcattctgatgaatgtactactgtccagcctcctcaggagaaccaaacatccagtataccttcaccagcaactttgccagtctcagcacttaaacaaccaggtgttgaagtgcctgctattggaaaaagctgaccaaagccagtaacaagagagtctgggaattgcactttccagacttccagcctggcatccaagagcccactgtagagggtgagcttgggtttgagaggcaataggactatgttccaaagaacagaagagagtatggtttgcagatggtatattgcccaatggtgaagttgcagatacaacaaaattatcatctggaagtaaaagatgttctgaagactttagtcctctctcacctgatgtgcctatgacagtaaacacagtggatcattcccattctactacagtggaaaagccaaacaatgagacaggagatattacaagaaatgagataattcagagtcctatttctcaggttccatcagtggaaaaattgtctatgaacacaggaaatgaggggttacctacttctggttcatttacactagatgatgatgtttttgcagaaactgaagaaccatctagtcctactggtgtcttagtt

SEQ ID NO: 204507 - DNA, 6599 bp, Homo sapiens
  Payload ID: 20339
  Gene Name: zinc finger, FYVE domain containing 16
  Uniprot ID: Q7Z3T8
  ENST ID: ENST00000505560
  CDS Start-End: 222-4841
ggtggggcggggaaagaagccctgagccgggatctggcactcccaggactcccggccggggtagctcttcactcctcagcgcgacgtcgtgtcgagttcccaaaaagctccgcaggggctgtagggagattcctgtgaggtttctcgggcttatttggtggagtttctgttccagaccagaggcatacaagaattaaattctgaataagtctgcaggtaggatggacagttattttaaagcagctgtcagtgacttggacaaactccttgatgattttgaacagaacccagatgaacaagattatctccaagatgtacaaaatgcatatgattctaaccactgctcagtttcttcagagttggcttcctcacagcgaacttcattgctcccaaaagaccaagagtgcgttaatagttgtgcctcatcagaaacaagctatggaacaaatgagagttccctgaatgaaaaaacactcaagggacttacttctatacaaaatgaaaaaaatgtaacaggacttgatcttctttcttctgtggatggtggtacttcagatgaaatccagccgttatatatgggacgatgtagtaaacctatctgtgatctgataagtgacatgggtaacttagttcatgcaaccaatagtgaagaagatattaaaaaattattgccagatgattttaagtctaatgcagattccttgattggattggatttatcttcagtgtcagatactccctgtgtttcttcaacagaccatgatagtgatactgtcagagaacaacagaatgatatcagttctgaattacaaaatagagaaatcggaggaatcaaagaattgggtataaaagtagatacaacactttcagattcctataattacagtggaacagaaaatttaaaagataaaaagatctttaatcagttagaatcaattgttgattttaacatgtcatctgctttgactcgacaaagttccaaaatgtttcatgccaaagacaagctacaacacaagagccagccatgtggattactaaaagatgttggcttagtaaaagaggaagtagatgtggcagtcataactgccgcagaatgtttaaaagaagagggcaagacaagtgctttgacctgcagccttccgaaaaatgaagatttatgcttaaatgattcaaattcaagagatgaaaatttcaaattacctgacttttcctttcaggaagataagactgttataaaacaatctgcacaagaagactcaaaaagtttagaccttaaggataatgatgtaatccaagattcctcttcagctttacatgtttccagtaaagatgtgccgtcctcattgtcctgtcttcctgcgtctgggtctatgtgtggatcattaattgaaagtaaagcacggggtgattttttacctcagcatgaacataaagataatatacaagatgcagtgactatacatgaagaaatacagaacagtgttgttctaggtggggaaccattcaaagagaatgatcttttgaaacaggaaaaatgtaaaagcatactccttcagtcattaattgaagggatggaagacagaaagatagatcctgaccagacagtaatcagagctgagtctttggatggtggtgacaccagttctacagttgtagaatctcaagaggggctttctggcactcatgtcccagagtcttctgattgttgtgaaggttttattaatactttttcaagcaatgatatggatgggcaagacttagattactttaatattgatgaaggcgcaaaaagtggcccactaattagtgatgctgaacttgatgcctttctgacagaacagtatcttcagaccactaacataaagtcttttgaagaaaatgtaaatgactctaaatcgcaaatgaatcagatagatatgaaaggcttagatgatggaaacatcaataatatatatttcaatgcagaagcaggagctattggggaaagtcatggtattaatataatttgtgaaatagttgataaacaaaatacaatagaaaatggcctttctttaggagaaaaaagcactattccagttcaacaagggttacctaccagtaagtctgagattacaaatcaattatcggtctctgatattaacagtcaatctgttggaggggccagacctaagcaattgtttagccttccatcaagaacaaggagttcaaaggacctgaataagccagatgttccagatacaatagaaagtgaacccagcacagcagataccgttgttccaatcacttgtgctatagattctacagctgatccacaggttagcttcaactctaattacattgatatagaaagtaattctgaaggtggatctagtttcgtaactgcaaatgaagattctgtacctgaaaacacttgcaaagaaggcttggttttgggccagaaacagcctacttgggttcctgattcagaagctccaaactgtatgaactgccaagtcaaatttacttttaccaaacggcgacaccattgccgagcatgtgggaaagtattttgtggtgtctgttgtaataggaagtgtaaactgcaatatctagaaaaggaagcaagagtatgtgtagtctgctatgaaactattagtaaagctcaggcatttgaaaggatgatgagtccaactggttctaatcttaagtctaatcattctgatgaatgtactactgtccagcctcctcaggagaaccaaacatccagtataccttcaccagcaactttgccagtctcagcacttaaacaaccaggtgttgaaggactatgttccaaagaacagaagagagtatggtttgcagatggtatattgcccaatggtgaagttgcagatacaacaaaattatcatctggaagtaaaagatgttctgaagactttagtcctctctcacctgatgtgcctatgacagtaaacacagtggatcattcccattctactacagtggaaaagccaaacaatgagacaggagatattacaagaaatgagataattcagagtcctatttctcaggttccatcagtggaaaaattgtctatgaacacaggaaatgaggggttacctacttctggttcatttacactagatgatgatgtttttgcagaaactgaagaaccatctagtcctactggtgtcttagttaacagcaatttacctattgctagtatttcagattataggttactgtgtgatattaacaagtatgtctgcaataagattagtcttctacctaatgatgaggacagtttgcccccacttctggttgcatctggagaaaagggatcagtgcctgtagtagaagaacatccatctcatgagcagatcattttgcttcttgaaggtgaaagctttcatcctgttacatttgtcctaaatgctaatctactcgtgaatgtcaaattcatattttattcctcagacaaatattggtacttttcaaccaatggattgcatggcttgggacaggcagaaattattattctattgttatgtttgccaaatgaagatactattcctaaggacatcttcagactatttatcaccatatataaggatgctctaaaaggaaaatacatagaaaacttggacaatattacctttactgagagttttctcagtagcaaggatcacggaggattcctgtttattacacctacttttcagaaacttgatgatctctcattaccaagtaatccttttctttgtggaattcttatccagaagcttgagattccctgggcaaaggtttttcctatgcgtttaatgttgagattgggtgcagaatataaagcatatcctgctcctctaacaagcatcagaggccgaaaacctctttttggagaaataggacacactattatgaacttacttgttgaccttcgaaattaccagtataccttgcataatatagatcaactgttgattcatatggaaatgggaaaaagctgcataaaaataccacggaaaaagtacagtgatgtaatgaaagtactaaattcttccaatgagcatgtcattagcattggagcaagtttcagtacagaagcagattctcatctagtctgtatacagaatgatggaatttatgaaacacaggccaacagtgccactggccatcctagaaaagtgacaggtgcaagttttgtggtattcaatggagctctaaaaacatcttcaggatttcttgctaagtccagcatagttgaagatggcttaatggtacaaataactccagagaccatgaatggcttgcggctagctttacgagaacagaaagactttaaaattacatgtgggaaagttgatgcagtagacctgagagaatacgtggatatctgctgggtagatgctgaagaaaaaggaaacaaaggagttatcagttcagtggatggaatatcattacaaggatttccaagtgaaaaaataaaactggaagcagattttgaaaccgatgagaagattgtaaaatgtaccgaggtgttctactttctaaaggaccaggatttatctattttatcaacttcttatcagtttgcaaaagaaatagccatggcttgtagtgctgcgctgtgccctcacctgaaaactctaaaaagtaatgggatgaataaaattggactcagagtttccattgacactgatatggttgaatttcaggcaggatctgaaggccaacttctgcctcagcattatctaaatgatcttgatagtgctctgatacctgtgatccatggtgggacctccaactctagtttaccattagaaatagaattagtgtttttcattatagaacatcttttttagtgaaagaatgtgccatattacatattgcaacctaatttgttaaaactaactccagcactaaagctgaaatgccacaaacactaaaagtataaatatgtctgatttttgaaacacataagctttgctctttaggcaggaatgatcttttcaaatcattagcacaatatttaaatatctaaaaatttaagagatccatactttctgtagctttacaattaatttaagtactaaaaagacaaggatttcttttaagaaatttatagcatttactgtgttatttaaatgctaagccaaagtatctgcacttaggtatacctctttatgccaataatgattttaatgaaggctcttttcagatgtaaccttatgaaggaaatatctgctttgtgtatatgccagttagaatactggtttctaaagtctgtcaaattgtatttcagtggcacaaaaaccagttttgaggtcttagacttataattctttgaataaaactgataacttatttgtataattggagtggagacctacctccataattagataaactctttttggattataatcagaattttgccttttttcttctcaaattattacatatgtatgtattatatatccacatatatagttttccctgattaaatggatattaaaataattgcgggtgcttcaggactttttgcttctatatttaagtatattgtttttatagcaagaacatattctgaatgttttataaatctttaataatttatatgtaggtaatatttttgtatcacaatgcattatttttttcctcctttccttccaaactataccactgtatttaccacttctaagagtgactgacgacgggccagatgacccttgaagtagtcattatgtagcaataaatgaagcctgaaacaggtttttttacttccactttaatccttagaaatttcttggcaacttcgcatattttcattgacaccagtgtataagtataaatttaaatgaactaattacttttgcatattttaaattctttatatggtagttattttttataacaggatattaacataagttaaatcctatgtatttgaaattgttacagagctttcctctttacttcaaacagcaaaaaagtggggggcatattgtagtcctgtcatttaagttatgtaaaaaatttaatcattattttgatgctttaaacattctcatgtgtaatatatgtttttgtatcaaaaacactcatatatttcaagaaaaagaaattatgttaaatagccctgttttaagaaaaatatttatgaagcatctcaacttgaagatcaagtcaaagttataactcaggatctgaggtctcaagctaggagagactgagaattttaatcagtttgggcatatagtttggactgaatcacatctgtagtacttagccaaagacaatttggaggagaatatcagccttctggaagtagctacttcctgaacaatgtaaagtgtcgcagatattcaataaaatggcaacctgttataatttgtgaaatttattgaaatggtgtaagatgaaaacaattgcatatcaaacccaatttatgttttctaaatatagtgtatgtattctgccatgtaagtaattgaacagtcttaaaataaccaaatggtagagggctgttccatgatgggacagctttggatttgttttcataaaatctctatattcaataaaaattggaattatgtgcctgaagtttggaggcacatttt

SEQ ID NO: 204508 - DNA, 1555 bp, Homo sapiens
  Payload ID: 20340
  Gene Name: zinc finger, FYVE domain containing 19
  Uniprot ID: Q96K21
  ENST ID: ENST00000299173
  CDS Start-End: 1-1212
atgaactacgactcccagcagcccccgttgccgccgctgccgtacgctggctgcaggagagcgtccggattccctgctctaggtcgcggcgggacagtgccagtgggcgtgtggggcggggcagggcagggaagggaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagtgaccctccaggactatcgcctcccagacagtgatgacgacgaggatgaggagacagccatccaaagagtcctgcagcagctcactgaagaagcttccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcattggg

SEQ ID NO: 204509 - DNA, 1784 bp, Homo sapiens
  Payload ID: 20340
  Gene Name: zinc finger, FYVE domain containing 19
  Uniprot ID: Q96K21
  ENST ID: ENST00000336455
  CDS Start-End: 56-1441
ggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacagcctgcccttctccaggtcgctggagttagattaccacacttcctcctgcttccggggcaccatggtgaaggctgactgtcctgtccctatcacagacctgccagattcctctggtaaactgcagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagcttccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcattggg

SEQ ID NO: 204510 - DNA, 2775 bp, Homo sapiens
  Payload ID: 20340
  Gene Name: zinc finger, FYVE domain containing 19
  Uniprot ID: Q96K21
  ENST ID: ENST00000355341
  CDS Start-End: 502-1917
gttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctaggtcgcggcgggacagtgccagtgggcgtgtggggcggggcagggcagggaagggaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagcttccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcattgggcccagcatctcatttctacaaccctatgagcctgggccctgtgagaggtggcaggaacagagcaggctgtaagcacagttgtggggaatgggggaaaaggttgagccatcctatgaacttctccaggcaggaacagccctacccatcctggtggcctcatacgaagtaaacatgtattcattcaactcaactgtgctccagctctgggcagccccacttagccaccagtccccaccatcttggatttctcagcctctctactactcacacaatgcacgcaggaacaatgcacacacaccctgcttcctgccttactggcaaaggaccccagctcctagggctcctgtcccaacctgcctgccattcagtctcagtatctctcttccagtaatgcgccctaaccggacccctgacctctcggcatgtaccctttacatgcctctgcattgcctctgctgtttctcttcctgcccctggctggaaccaactataaagagccctcgggctgaggtcta

SEQ ID NO: 204511 - DNA, 812 bp, Homo sapiens
  Payload ID: 20340
  Gene Name: zinc finger, FYVE domain containing 19
  ENST ID: ENST00000561617
  CDS Start-End: 1-812
cccaggacttggccggcgtgatctcagctctgcagaccctgcggtgctgggagccaccatggagagtaggtgctacggctgcgctgtcaagttcaccctcttcaagaaggagtacggctgtaagaattgtggcagggccttctgttcaggctgcctaagcttcagtgcagcagtgcctcggactgggaacacccaacagaaagtctgcaagcaatgccatgaggtcctgaccaggcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagag

SEQ ID NO: 204512 - DNA, 580 bp, Homo sapiens
  Payload ID: 20340
  Gene Name: zinc finger, FYVE domain containing 19
  ENST ID: ENST00000568062
  CDS Start-End: 1-305
gcaggagagcgtccggattccctgctctaggtcgcggcgggacagtgccagtgggcgtgtggggcggggcagggcagggaagggaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggagggtttatgtgagggtccactgaagtgctttagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagag

SEQ ID NO: 204513 - DNA, 1669 bp, Homo sapiens
  Payload ID: 20340
  Gene Name: zinc finger, FYVE domain containing 19
  ENST ID: ENST00000570108
  CDS Start-End: 204-1550
agcgttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctaccctgcggtgctgggagccaccatggagagtaggtgctacggctgcgctgtcaagttcaccctcttcaagaaggagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagcttccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggcccct

SEQ ID NO: 204514 - DNA, 922 bp, Homo sapiens
  Payload ID: 20340
  Gene Name: zinc finger, FYVE domain containing 19
  ENST ID: ENST00000566407
  CDS Start-End: 1-922
ggcgggacagtgccagtgggcgtgtggggcggggcagggcagggaagggaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccaggtctccctcttcaagtgaccctccaggactatcgcctcccagacagtgatgacgacgaggatgaggagacagccatccaaagagtcctgcagcagctcactgaagaagcttccctggatgaggcaagtggctttaacatccctgcagagcaggcttctcgaccctggacgcaaccccgcgggg

SEQ ID NO: 204515 - DNA, 1486 bp, Homo sapiens
  Payload ID: 20340
  Gene Name: zinc finger, FYVE domain containing 19
  ENST ID: ENST00000561768
  CDS Start-End: 1-65
gccggcgtgatctcagctctgcagaccctgcggtgctgggagccaccatggagatacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagcttccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcc

SEQ ID NO: 204516 - DNA, 1036 bp, Homo sapiens
  Payload ID: 20340
  Gene Name: zinc finger, FYVE domain containing 19
  ENST ID: ENST00000569057
  CDS Start-End: 1-154
acttggccggcgtgatctcagctctgcagaccctgcggtgctgggagccaccatggagagtaggtgctacggctgcgctgtcaagttcaccctcttcaagaaggagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagcttccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctg

SEQ ID NO: 204517 - DNA, 2059 bp, Homo sapiens
  Payload ID: 20340
  Gene Name: zinc finger, FYVE domain containing 19
  Uniprot ID: Q96K21
  ENST ID: ENST00000564258
  CDS Start-End: 830-1720
gttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagcttccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcat

SEQ ID NO: 204518 - DNA, 617 bp, Homo sapiens
  Payload ID: 20340
  Gene Name: zinc finger, FYVE domain containing 19
  ENST ID: ENST00000566767
  CDS Start-End: 447-617
catttggcttgaataaggtactggaaaccgaggaattgctttactcaccatccctaggccttaggggccccactcctcttcttcctcccagcagctggtcataacttcagtgacttctctctgtgtgtgcttggagagtccctgggagcagcctgcaggggcgggtgagagggggatctcccgcttcatgtttcttgtagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttcta

SEQ ID NO: 204519 - DNA, 571 bp, Homo sapiens
  Payload ID: 20340
  Gene Name: zinc finger, FYVE domain containing 19
  ENST ID: ENST00000567756
  CDS Start-End: 1-144
agctggggtgagggtccaaggggcccaggacttggccggcgtgatctcagctctgcagaccctgcggtgctgggagccaccatggagagtaggtgctacggctgcgctgtcaagttcaccctcttcaagaaggaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagccca

SEQ ID NO: 204520 - DNA, 1521 bp, Homo sapiens
  Payload ID: 20341
  Gene Name: zinc finger, FYVE domain containing 21
  Uniprot ID: Q9BQ24
  ENST ID: ENST00000216602
  CDS Start-End: 113-871
gattggacgccggcgctgtcagccgcgcgcggaccggggcggggcgggcggtgccccgggctgggcgaggggccgggtgcggggccgctggccgagaggctgaggcggcgtcatgtcctccgaggtgtccgcgcgccgcgacgccaagaagctggtgcgctccccgagcggcctgcgcatggtgcccgaacaccgcgccttcggaagcccgttcggcctggaggagccgcagtgggtcccggacaaggagtgtcggagatgtatgcagtgtgacgccaagtttgactttctcaccagaaagcaccactgtcgccgctgcgggaagtgcttctgcgacaggtgctgcagccagaaggtgccgctgcggcgcatgtgctttgtggaccccgtgcggcagtgcgcggagtgcgccctcgtgtccctcaaggaggcggagttctacgacaagcagctcaaagtgctcctgagcggagccaccttcctcgtcacgtttggaaactcagagaaacctgaaactatgacttgtcgtctttccaataaccagagatacttgtttctggatggagacagccactatgaaatcgaaattgtacacatttccaccgtgcagatcctcacagaaggcttccctcctggagaaaaagacattcacgcttacaccagcctccgggggagccagcctgcctctgaaggaggcaacgcacgggccacaggcatgttcctgcagtatacagtgccggggacggagggtgtgacccagctgaagctgacagtggtggaggacgtgactgtgggcaggaggcaggcggtggcgtggctagtggccatgcacaaggctgccaagctcctctatgaatctcgggaccagtaactctacgtggggctgagcttggagtacgtgtggtcaccaggactgagtcgcttggaacagcagagcctgctccttgcgtaccacagggattaatcctgcttgtgctgggaaatgcaactcactcatgtatttggagaaacaggagtgttcacttatctagtgcaatatgttcacagtttattaatgctttaaacagcttcatgttttagaatttgtgtattgtcaatacttaattgggggtgggagagactgagctacactactgctaaactatttttagcataatatataccatttttatgagttcgcaggtctactagaaggttctggcccatcaatattcatttcatttaattcttccacagaaccagtttgggcagtaggaactcaggcttctggtctgcagtggagcctgttcgcctctaatagccagtttacagcacttgccttagcctgtttcacagacttgtccacttaccttgtcactaatttggggcttctgggctgtgagtgatcctttgatacttcaccaaggggaacgtgggggctttgtgttttgtacttttcactcactatttcactttattaagatgactgtacagcaatttgtatataaagcttatgattaaaaactattttgaacatacgga

SEQ ID NO: 204521 - DNA, 1383 bp, Homo sapiens
  Payload ID: 20341
  Gene Name: zinc finger, FYVE domain containing 21
  Uniprot ID: Q9BQ24
  ENST ID: ENST00000311141
  CDS Start-End: 35-739
gcggggccgctggccgagaggctgaggcggcgtcatgtcctccgaggtgtccgcgcgccgcgacgccaagaagctggtgcgctccccgagcggcctgcgcatggtgcccgaacaccgcgccttcggaagcccgttcggcctggaggagccgcagtgggtcccggacaaggagtgtcggagatgtatgcagtgtgacgccaagtttgactttctcaccagaaagcaccactgtcgccgctgcgggaagtgcttctgcgacaggtgctgcagccagaaggtgccgctgcggcgcatgtgctttgtggaccccgtgcggcagtgcgcggagtgcgccctcgtgtccctcaaggaggcggagttctacgacaagcagctcaaagtgctcctgagcggagccaccttcctcgtcacgtttggaaactcagagaaacctgaaactatgacttgtcgtctttccaataaccagagatacttgtttctggatggagacagccactatgaaatcgaaattgtacacatttccaccgtgcagatcctcacagaaggcttccctcctggaggaggcaacgcacgggccacaggcatgttcctgcagtatacagtgccggggacggagggtgtgacccagctgaagctgacagtggtggaggacgtgactgtgggcaggaggcaggcggtggcgtggctagtggccatgcacaaggctgccaagctcctctatgaatctcgggaccagtaactctacgtggggctgagcttggagtacgtgtggtcaccaggactgagtcgcttggaacagcagagcctgctccttgcgtaccacagggattaatcctgcttgtgctgggaaatgcaactcactcatgtatttggagaaacaggagtgttcacttatctagtgcaatatgttcacagtttattaatgctttaaacagcttcatgttttagaatttgtgtattgtcaatacttaattgggggtgggagagactgagctacactactgctaaactatttttagcataatatataccatttttatgagttcgcaggtctactagaaggttctggcccatcaatattcatttcatttaattcttccacagaaccagtttgggcagtaggaactcaggcttctggtctgcagtggagcctgttcgcctctaatagccagtttacagcacttgccttagcctgtttcacagacttgtccacttaccttgtcactaatttggggcttctgggctgtgagtgatcctttgatacttcaccaaggggaacgtgggggctttgtgttttgtacttttcactcactatttcactttattaagatgactgtacagcaatttgtatataaagcttatgattaaaaactattttgaaca

SEQ ID NO: 204522 - DNA, 636 bp, Homo sapiens
  Payload ID: 20341
  Gene Name: zinc finger, FYVE domain containing 21
  ENST ID: ENST00000553512
  CDS Start-End: 16-297
ggctgaggcggcgtcatgtcctccgaggtgtccgcgcgccgcgacgccaagaagctggtgcgctccccgagcggcctgcgcatggtgcccgaacaccgcgccttcggaagcccgttcggcctggaggagccgcagtgggtcccggacaaggagtgtcggagatgtatgcagtgtgacgccaagtttgactttctcaccagaaaggtgaggcggatccccgctgcgtggtggggagcccaggggctggcgacaggaggtgcgcgtgtgcagcggccggcacaggggcctcgcgtttaggcgtggcccggggagtgccaggccagccggggccacacccggggccgcttgttccctgcccctcctcactgccaatcctcccgcatctgcccagcaccactgtcgccgctgcgggaagtgcttctgcgacaggtgctgcagccagaaggtgccgctgcggcgcatgtgctttgtggaccccgtgcggcagtgcgcggagtgcgccctcgtgtccctcaaggaggcggagttctacgacaagcagctcaaagtgctcctgagcggagccaccttcctcgtcacgtttggaaactcagagaaacctgaaactatgacttgtcgtctttccaataaccagag

SEQ ID NO: 204523 - DNA, 364 bp, Homo sapiens
  Payload ID: 20341
  Gene Name: zinc finger, FYVE domain containing 21
  ENST ID: ENST00000556610
  CDS Start-End: 4-192
gtcatgtcctccgaggtgtccgcgcgccgcgacgccaagaagctggtgcgctccccgagcggcctgcgcatggtgcccgaacaccgcgccttcggaagcccgttcggcctggaggagccgcagtgggtcccggacaaggaggagccaccttcctcgtcacgtttggaaactcagagaaacctgaaactatgacttgtcgtctttccaataaccagagatacttgtttctggatggagacagccactatgaaatcgaaattgtacacatttccaccgtgcagatcctcacagaaggcttccctcctggagaaaaagacattcacgcttacaccagcctccgggggagccagcctgcctctgaagg

SEQ ID NO: 204524 - DNA, 430 bp, Homo sapiens
  Payload ID: 20341
  Gene Name: zinc finger, FYVE domain containing 21
  ENST ID: ENST00000555163
  CDS Start-End: 1-346
caaagtgctcctgagcggagccaccttcctcgtcacgtttggaaactcagagaaacctgaaactatgacttgtcgtctttccaataaccagagatacttgtttctggatggagacagccactatgaaatcgaaattgtacacatttccaccgtgcagatcctcacagaaggcttccctcctggagaaaaagacattcacgcttacaccagcctccgggggagccagcctgcctctgaaggtcagcctcttcctcctcaccggggctccccgcatgcagcgggcccgttcctcccctcgccacctggcttctgtccacggggtggtccatgccaaggttctttgtgaaacctgaattcacttactttggttgacttaagagagatgttggatctgataagtgggtttataaagcataaatgaagataccgc

SEQ ID NO: 204525 - DNA, 9675 bp, Homo sapiens
  Payload ID: 20342
  Gene Name: zinc finger, FYVE domain containing 26
  Uniprot ID: Q68DK2
  ENST ID: ENST00000347230
  CDS Start-End: 140-7759
actcggctcaaacatggctgcgctgagagctctattgctttgggcgccgggagcaggaggtactccgcgaatgagaacattgagaatgtgttcggcataactcatttctttgtatctccctgcactctgtgctgggaaaatgaatcatccatttggaaaagaggaagctgcttcgcagaagcagctttttggatttttctgcgaatgcctgcggaggggagaatgggagctggcacaggcatgtgtacctcagctacaggagggacaaggggatatcccaaagagggtagaagacatacttcaggcattggtggtgtgtccaaatctgctgagatgtgggcaggacatcaaccctcaaagagtagcctgggtctggcttcttgtactggagaaatggttggcccgggaaaagaagttactcccagttgttttccggagaaagcttgagtttcttttattgtcagaagacctccaaggtgacattccagagaacatcctcgaggagctgtatgagaccttaacacagggtgcagtaggccacgtgcctgacggaaatccaaggagggagagctggactcctcgtctcagctccgaagctgtctctgtgctctgggatctcctgaggcagtctccccagccagcacaggccctgctggagctcctgcttgaggaggatgacggtactggcctctgtcactggcctctgcagaatgcactggtggacctcattcgaaaggcattgcgggctttgcagggccctgattcggtgccccctggggtagtcgatgccatctatggagccctgcggactctgcgttgccccgcagaaccacttggggttgagttgcatctcctgtgtgaggaactactagaggcctgcaggaccgaggggagtcccctgcgggaggagcggctgctcagctgcctgctgcacaaggccagccggggcctgctgtccctgtatggccatacctatgcagagaaggtcacagaaaagccaccgagggctacagcctcgggaaaagtctcaccggatcatctagatcctgagcgggcaatgctagccctgttctccaatcccaacccagccgaggcttggaaagtggcctatttctactgcctgagcaacaacaaacacttcctcgagcagattctggtaacagcactaacattgttgaaagaagaagacttcccaaatcttggctgcctacttgatagagaattcaggcccctcagttgcctgcttgtactcctgggctggacacactgccagagcctagagtcagccaagaggctgctccagaccctgcacaggacccagggcccaggctgtgatgagctcctcagggatgcctgtgatgggttgtgggctcacctggaggtcctggagtggtgcatacagcagagcagcaaccccataccaaagagagatctgttgtatcatttacacggtggagacagccactcagtgctctacactctccatcaccttacaaaccttccagccctcagggaggaagatgttctcaagctcttacagaaagtgccagccaaggacccccagcaagagcctgatgcagttgatgctccagtccctgagcacctgagccagtgtcagaacctgacactctaccagggcttctgtgccatgaagtatgccatctatgccctctgtgtaaactcacaccagcactcccagtgccaggactgcaaagacagcctctctgaggacctggcctcagctacagagccagcgaatgactctctctcctccccaggtgctgcaaatctcttctcaacttacctggccaggtgtcaacagtatctgtgcagtattcctgactctctgtgcctggagcttctggaaaacatcttctcattgcttctcatcacctctgctgatcttcacccagagcctcacttgcctgaggactatgctgaggatgatgacattgaggggaagagcccctcaggtttgaggtccccatcagagagccctcagcacatagcacatcctgaaaggaagtcagaacggggttccctgggagtcccaaagacccttgcttatacaatgccaagccatgtgaaggcagagccaaaagacagttacccagggcctcataggcacagctttttggacttaaaacactttactagtggtatcagtggatttctggctgatgaatttgcaataggggccttcctcaggcttctccaagagcaactggatgagatcagtagccgcagccctcctgagaagccaaagcaagaaagtcagagctgctcaggaagcagagatggactgcagagccgcctgcatcgactttccaaggttgtctctgaggcccagtggagacacaaggtggtgacaagcaaccatcgttcagaggagcaaccttcccgaagataccagcctgccacacgtcaccccagtctccgccggggtcgtcggacaagaaggagccaggcagatggccgagacagaggttcaaacccatccctggaaagtacaagtagtgagctgagcacaagtacgtcagagggaagtctgagtgccatgtctggccggaatgagctgcacagtagattgcacccccatcctcaaagttcactcatccccatgatgttctccccacctgagtcactgctggcatcctgcatccttcgcgggaacttcgcagaagcccatcaggtgctgttcacgttcaacctgaagtcctcacccagttcaggggaactgatgttcatggagcgctaccaggaagtgatccaagaactggcccaagtagagcacaagattgaaaaccagaactcagatgcgggtagcagcaccattcggagaactggcagtggccgctcaactctacaggccattggcagcgctgcagcagcaggaatggtgttttactctatctctgacgtgactgacaagctgctcaacacctctggagaccccatccccatgctccaggaggacttttggataagcacggctctagtggagcccactgctcccctgagagaggttctggaagacctcagtccccctgccatggctgcatttgacctagcttgctctcagtgccagctctggaaaacctgcaagcagcttttggagacagccgaacggcgtttgaatagtagccttgaaaggcggggtcgacggatagaccacgtactcctaaatgctgatggcattcgaggttttccagttgttcttcagcaaatcagtaagagtctcaattatctgcttatgtcagccagtcaaaccaaatcagagagtgtggaagaaaagggaggaggccctccacggtgcagcatcactgaactgcttcagatgtgctggcccagcctaagcgaggactgtgttgccagccacaccaccctctcccagcagctagatcaggtccttcagtcactgagagaggcactagagctgccagagcccaggactcctccactgtcttccctggtggagcaggcagcccagaaagctccagaggcagaggcccaccctgtgcagatccagactcagctcctccagaagaacctgggcaaacagaccccatcaggcagcaggcagatggactacttgggcaccttcttcagttactgcagcacccttgctgcagttctccttcaaagtttgagctctgagcctgatcatgtggaggtcaaggtaggaaatccctttgttctgctgcaacagagctcttcccaactggtgtcacatctcctgtttgagagacaagttcccccagagagactggcagcccttctggcccaagagaatctcagcctaagtgtgccacaggtcatcgtcagctgctgctgtgagccccttgctctttgctcatcccggcaaagccagcagacctcctccctcctgactcgtctgggtactctggcccagctacacgcctctcactgcctggatgacctcccactttctacaccgagctccccgaggacaactgagaaccctacattggaaagaaagccctactcctccccaagggactcatcactcccagccctcacctcctctgccttggcctttcttaagtcacgctcaaagctcctagctacggtggcctgcctgggggcttccccgaggttaaaggtcagcaaacccagcttgtcatggaaggaacttcgtggccgcagggaggtgcctctggctgcagagcaggtagcccgggagtgtgagcgccttctggaacaattccctctgtttgaggccttcctcctggctgcctgggagcccctgcgagggtctttgcagcaggggcagagtctggcagtgaatctctgtggttgggccagtctttctaccgttctcctgggcctacattctcccattgccctagatgtactgagtgaggcttttgaggaatccttggtggccagagattggtcccgggcccttcagctcactgaagtgtacgggcgagatgtggacgatttgagcagcataaaggatgcagtcctgagctgtgctgtggcatgtgacaaagaaggttggcaatacctgtttcccgtgaaggatgcatctctgagaagtcggctggccctacagtttgtggacaggtggcccctggagtcatgcctggagattctggcctactgcatttcagacacggctgtccaagaaggactaaagtgtgagctacagaggaagctggcggagctgcaggtgtatcagaagattctgggtttgcagtctcccccagtgtggtgtgactggcagaccttgaggagctgttgtgttgaggacccatcaactgtcatgaacatgattctagaagcacaggagtatgaactgtgtgaagagtggggctgcctgtaccccattccaagagaacatttaatcagccttcatcaaaagcatcttctccaccttctagaaagaagagatcatgacaaggctctgcaactcctgcgaagaatccctgaccccaccatgtgccttgaagtgacagagcaatccctcgaccagcacactagcttggccacttctcacttcttggccaactacctcaccacccacttctatggacaactgactgctgtccgacaccgtgaaatccaggcgctgtatgtgggatccaagattctgctgaccctgcctgagcagcaccgggccagctattcccacttgtcctctaaccccctgttcatgctggagcagctgcttatgaacatgaaggtggattgggccactgtggctgtgcagactctccagcagctgctggttggacaggagattggcttcactatggacgaggtggactcactgctttccagatacgcagagaaagccctggactttccataccctcagagggagaaacgatcagattctgtgattcacctccaagaaattgtccaccaggctgcagatcccgagaccctccctagatcaccatcagcagagttctctcctgctgctcctcctggtatctccagtatacattcccctagtctaagggaaaggagtttcccaccaacccagccctcacaggaatttgtgcccccagcgacaccccctgccaggcaccagtgggtaccggatgagactgagagtatctgcatggtctgctgcagggagcacttcaccatgtttaacaggcgtcatcattgtcgccgctgtggccggctagtgtgcagctcctgctccactaagaaaatggtggttgaaggctgcagagagaaccctgctcgtgtgtgtgatcagtgctatagttactgcaacaaagatgtaccagaggagccttcagaaaaaccagaagctctagacagctccaagaatgaaagccctccatactcgtttgtggtgagagtccccaaagcagatgaggtggaatggattttggatctcaaagaggaggaaaatgagctggtgcggagtgaattttactatgagcaggcccccagcgcctccttgtgcattgccatcctgaatctgcaccgggacagcattgcctgtggtcaccagctgattgagcactgctgcaggctctccaagggcctcaccaacccagaggtggatgccgggctgctcacggacatcatgaagcagctgctgttcagcgccaagatgatgttcgtcaaagccggccagagccaagacttggctctttgtgacagctacatcagcaaggtagatgtgctgaatattttagttgctgctgcctatcgccacgtgccatctttggatcagatcttgcagccagctgcagtaaccaggctaaggaaccagcttttggaagccgagtactaccaactgggcgttgaggtctccacaaagactgggcttgataccaccggggcgtggcatgcttggggcatggcctgcctcaaagccgggaacctcactgctgcacgggagaagttcagtcgctgtctgaagcccccatttgacctcaatcagctgaatcatggctcaaggctggtgcaggatgtggttgagtacctagagtccacagtgaggccctttgtatccttgcaagatgacgattactttgccaccctgagggaactggaagctacccttcggacgcagagcctttctctggcagtgattcctgaagggaaaatcatgaacaacacctactaccaggaatgcctcttctacctgcacaactatagcaccaacctggccatcatcagcttctacgtgaggcacagctgcctgcgggaagctcttctgcaccttctcaacaaggagagtcctccagaagtttttatagaaggcattttccaaccaagctataaaagtgggaagctacacactttggagaacttgctagaatccattgatccaaccttggagagctggggaaagtacttgattgctgcctgccaacatttacagaagaagaactactaccacattctgtatgagctgcagcagtttatgaaggaccaagttcgggccgccatgacctgtattcggttcttcagtcacaaagcaaagtcatatacagaactgggagagaagctctcatggctacttaaggccaaggaccacctgaagatctacctccaagaaacatcccgcagctctggaaggaagaaaaccacattcttcagaaagaagatgactgcagctgatgtgtcaaggcacatgaacacacttcagctgcagatggaagtgaccaggttcttgcatcggtgcgaaagtgctgggacctctcaaatcaccactttgcctctgccaaccctgtttggaaataaccacatgaaaatggatgttgcctgcaaggtcatgctgggagggaaaaatgtagaagatggttttggaattgctttccgtgttctgcaggacttccagctggatgctgccatgacctactgcagagctgcccgccagttggtggagaaagagaagtacagtgagatccagcaactgctcaaatgtgtcagtgagtcaggcatggcagccaaaagtgacggggacaccatcctcctcaactgcctggaagcgttcaagagaattccgccccaggagctggagggcctgatccaggcaatacacaatgatgacaacaaggttcgggcctacctgatatgttgcaaactgcgttctgcctacttgattgctgtgaagcaagaacactcacgggccacagcccttgtccagcaggtgcagcaggccgccaagagcagcggggatgcagtagtgcaagacatctgtgcccagtggcttctgacaagccacccccggggtgcccatggcccaggctccaggaagtgaccttgggcagtggggccaggaacacgtggcctgagagctgggcaacagcagtgatggcgatgccctccacctctttcctccagtggagtgggacttctctggctctgccctaggttggaaagagttggattggaccctacttgccttcccgggcaaggataggacctttcacgcaagtgccatgtttctctaaaattgtggaatctatgtgtgtttgtctggagatggccagttctttctacctcagagtgagtgagtgagtatgtgtgcacacacgtgtgcatgttcctgtgcgctgatgtttacgcccaagcatttctgaacaaatgaaactcttctccatttaaaagaggcactttactttagacttgccactctgaaaaccttccctgcgttttggttcttgacccgggttgtcctgtttgtatagtcccccctctgtggacgtgctttagtagctcctcttacctagagggcttttacagagaattagagcaacaccaaaaggattgcctcttttccttccttcccattccaaaattcagagatggctttggggcaagtgctacctgtggaataaacctgttttccaggtgtctcttctcccaagcacaagaagtcctggagtctttggaaggtagtctgaatagaagggttttcaggtgcaggcatctgaaagctgtgggtatgtgtataaatgatcaggtctgtgaggctaacacgggcaagagggaaagaaaggctaaccatccaaacagggatacaggggaggcggtggggggtggtggggggagcgggtgctcacaagcacagagctgcctgttgtgaatgtccctgctgcaaagttggtgggtgagagaatgggacttcctctttgagagtctggggagagaaaaggtggccaggatcctaggactgaatgactcgattttacctatttgagctgcagtcctgtttgcgctccttgaattggttaggaagctgcttccttttccctcctgcttcccttcagtctcttcaggaccacaggatggatatgcagacatgtggggtcattgggaagggagtgcgcttcttttctctgtcttagaaaagggagtcaagggttggctttggaattgggcctctggacagagtcagaatgagggaataatgaataggtcacatctggttggtggaaaactaggtgaagtgcttctttaatatgcactgtcttgtcttcccacgcaagatgtgacaatgtttgagaaaaggtgtgtcatactcagtgacttcaatttgcaaatgtggggcctaaagaaagctctgcagctctgaacctctcactggccagagctcagcctattggtcccatccatgatgctgagacaaacagaaactggaagctgaagtcagtgtctctggtgctcagaaaccctgtggatttccctctgaaccaagatttttagtagtaaaataaacaactcatggacatctgtcagatgagaagttttggtcctgttagagaggagaaagactgtaatgaaactactagacccatttgggctaaagtttggcttttccttccttgagtcatagaacgtatccatctcccaggaaatgtccttctctggcgtctgcttgcccttctgagtctgccttttttgcactgaacataagcactttatactaatgggtcacaaatcttgcagcccttaatttgggataagaccagattttcctgacattttcctctaactcattgaactatcaaattataggcaaccactgactagactgatatgagatgaggctaaaagcctttgaacaccacgctgtagtctccaacagaaaaacaccaccaaaacagatacccatgttgaggggttgaatgttttactacaaacaagccacaataaagtgtctatcaacatgtt

SEQ ID NO: 204526 - DNA, 7466 bp, Homo sapiens
  Payload ID: 20342
  Gene Name: zinc finger, FYVE domain containing 26
  ENST ID: ENST00000554557
  CDS Start-End: 131-1465
aaacatggctgcgctgagagctctattgctttgggcgccgggagcaggaggtactccgcgaatgagaacattgagaatgtgttcggcataactcatttctttgtatctccctgcactctgtgctgggaaaatgaatcatccatttggaaaagaggaagctgcttcgcagaagcagctttttggatttttctgcgaatgcctgcggaggggagaatgggagctggcacaggcatgtgtacctcagctacaggagggacaaggggatatcccaaagagggtagaagacatacttcaggcattggtggtgtgtccaaatctgctgagatgtgggcaggacatcaaccctcaaagagtagcctgggtctggcttcttgtactggagaaatggttggcccgggaaaagaagttactcccagttgttttccggagaaagcttgagtttcttttattgtcagaagacctccaaggtgacattccagagaacatcctcgaggagctgtatgagaccttaacacagggtgcagtaggccacgtgcctgacggaaatccaaggagggagagctggactcctcgtctcagctccgaagctgtctctgtgctctgggatctcctgaggcagtctccccagccagcacaggccctgctggagctcctgcttgaggaggatgacggtactggcctctgtcactggcctctgcagaatgcactggtggacctcattcgaaaggcattgcgggctttgcagggccctgattcggtgccccctggggtagtcgatgccatctatggagccctgcggactctgcgttgccccgcagaaccacttggggttgagttgcatctcctgtgtgaggaactactagaggcctgcaggaccgaggggagtcccctgcgggaggagcggctgctcagctgcctgctgcacaaggccagccggggcctgctgtccctgtatggccatacctatgcagagaaggtcacagaaaagccaccgagggctacagcctcgggaaaagtctcaccggatcatctagatcctgagcgggcaatgctagccctgttctccaatcccaacccagccgaggcttggaaagtggcctatttctactgcctgagcaacaacaaacacttcctcgagcagattctggtaacagcactaacattgttgaaagaagaagacttcccaaatcttggctgcctacttgatagagaattcaggcccctcagttgcctgcttgtactcctgggctggacacactgccagagcctagagtcagccaagaggctgctccagaccctgcacaggacccagggcccaggctgtgatgagctcctcagggatgcctgtgatgggttgtgggctcacctggaggtcctggagtggtgcatacagcagagcaggtgctgcaaatctcttctcaacttacctggccaggtgtcaacagtatctgtgcagtattcctgactctctgtgcctggagcttctggaaaacatcttctcattgcttctcatcacctctgctgatcttcacccagagcctcacttgcctgaggactatgctgaggatgatgacattgaggggaagagcccctcaggtttgaggtccccatcagagagccctcagcacatagcacatcctgaaaggaagtcagaacggggttccctgggagtcccaaagacccttgcttatacaatgccaagccatgtgaaggcagagccaaaagacagttacccagggcctcataggcacagctttttggacttaaaacactttactagtggtatcagtggatttctggctgatgaatttgcaataggggccttcctcaggcttctccaagagcaactggatgagatcagtagccgcagccctcctgagaagccaaagcaagaaagtcagagctgctcaggaagcagagatggactgcagagccgcctgcatcgactttccaaggttgtctctgaggcccagtggagacacaaggtggtgacaagcaaccatcgttcagaggagcaaccttcccgaagataccagcctgccacacgtcaccccagtctccgccggggtcgtcggacaagaaggagccaggcagatggccgagacagaggttcaaacccatccctggaaagtacaagtagtgagctgagcacaagtacgtcagagggaagtctgagtgccatgtctggccggaatgagctgcacagtagattgcacccccatcctcaaagttcactcatccccatgatgttctccccacctgagtcactgctggcatcctgcatccttcgcgggaacttcgcagaagcccatcaggtgctgttcacgttcaacctgaagtcctcacccagttcaggggaactgatgttcatggagcgctaccaggaagtgatccaagaactggcccaagtagagcacaagattgaaaaccagaactcagatgcgggtagcagcaccattcggagaactggcagtggccgctcaactctacaggccattggcagcgctgcagcagcaggaatggtgttttactctatctctgacgtgactgacaagctgctcaacacctctggagaccccatccccatgctccaggaggacttttggataagcacggctctagtggagcccactgctcccctgagagaggttctggaagacctcagtccccctgccatggctgcatttgacctagcttgctctcagtgccagctctggaaaacctgcaagcagcttttggagacagccgaacggcgtttgaatagtagccttgaaaggcggggtcgacggatagaccacgtactcctaaatgctgatggcattcgaggttttccagttgttcttcagcaaatcagtaagagtctcaattatctgcttatgtcagccagtcaaaccaaatcagagagtgtggaagaaaagggaggaggccctccacggtgcagcatcactgaactgcttcagatgtgctggcccagcctaagcgaggactgtgttgccagccacaccaccctctcccagcagctagatcaggtccttcagtcactgagagaggcactagagctgccagagcccaggactcctccactgtcttccctggtggagcaggcagcccagaaagctccagaggcagaggcccaccctgtgcagatccagactcagctcctccagaagaacctgggcaaacagaccccatcaggcagcaggcagatggactacttgggcaccttcttcagttactgcagcacccttgctgcagttctccttcaaagtttgagctctgagcctgatcatgtggaggtcaaggtaggaaatccctttgttctgctgcaacagagctcttcccaactggtgtcacatctcctgtttgagagacaagttcccccagagagactggcagcccttctggcccaagagaatctcagcctaagtgtgccacaggtcatcgtcagctgctgctgtgagccccttgctctttgctcatcccggcaaagccagcagacctcctccctcctgactcgtctgggtactctggcccagctacacgcctctcactgcctggatgacctcccactttctacaccgagctccccgaggacaactgagaaccctacattggaaagaaagccctactcctccccaagggactcatcactcccagccctcacctcctctgccttggcctttcttaagtcacgctcaaagctcctagctacggtggcctgcctgggggcttccccgaggttaaaggtcagcaaacccagcttgtcatggaaggaacttcgtggccgcagggaggtgcctctggctgcagagcagacaaagaaggttggcaatacctgtttcccgtgaaggatgcatctctgagaagtcggctggccctacagtttgtggacaggtggcccctggagtcatgcctggagattctggcctactgcatttcagacacggctgtccaagaaggactaaagtgtgagctacagaggaagctggcggagctgcaggtgtatcagaagattctgggtttgcagtctcccccagtgtggtgtgactggcagaccttgaggagctgttgtgttgaggacccatcaactgtcatgaacatgattctagaagcacaggagtatgaactgtgtgaagagtggggctgcctgtaccccattccaagagaacatttaatcagccttcatcaaaagcatcttctccaccttctagaaagaagagatcatgacaaggctctgcaactcctgcgaagaatccctgaccccaccatgtgccttgaagtgacagagcaatccctcgaccagcacactagcttggccacttctcacttcttggccaactacctcaccacccacttctatggacaactgactgctgtccgacaccgtgaaatccaggcgctgtatgtgggatccaagattctgctgaccctgcctgagcagcaccgggccagctattcccacttgtcctctaaccccctgttcatgctggagcagctgcttatgaacatgaaggtggattgggccactgtggctgtgcagactctccagcagctgctggttggacaggagattggcttcactatggacgaggtggactcactgctttccagatacgcagagaaagccctggactttccataccctcagagggagaaacgatcagattctgtgattcacctccaagaaattgtccaccaggctgcagatcccgagaccctccctagatcaccatcagcagagttctctcctgctgctcctcctggtatctccagtatacattcccctagtctaagggaaaggagtttcccaccaacccagccctcacaggaatttgtgcccccagcgacaccccctgccaggcaccagtgggtaccggatgagactgagagtatctgcatggtctgctgcagggagcacttcaccatgtttaacaggcgtcatcattgtcgccgctgtggccggctagtgtgcagctcctgctccactaagaaaatggtggttgaaggctgcagagagaaccctgctcgtgtgtgtgatcagtgctatagttactgcaacaaagatgtaccagaggagccttcagaaaaaccagaagctctagacagctccaagaatgaaagccctccatactcgtttgtggtgagagtccccaaagcagatgaggtggaatggattttggatctcaaagaggaggaaaatgagctggtgcggagtgaattttactatgagcaggcccccagcgcctccttgtgcattgccatcctgaatctgcaccgggacagcattgcctgtggtcaccagctgattgagcactgctgcaggctctccaagggcctcaccaacccagaggtggatgccgggctgctcacggacatcatgaagcagctgctgttcagcgccaagatgatgttcgtcaaagccggccagagccaagacttggctctttgtgacagctacatcagcaaggtagatgtgctgaatattttagttgctgctgcctatcgccacgtgccatctttggatcagatcttgcagccagctgcagtaaccaggctaaggaaccagcttttggaagccgagtactaccaactgggcgttgaggtctccacaaagactgggcttgataccaccggggcgtggcatgcttggggcatggcctgcctcaaagccgggaacctcactgctgcacgggagaagttcagtcgctgtctgaagcccccatttgacctcaatcagctgaatcatggctcaaggctggtgcaggatgtggttgagtacctagagtccacagtgaggccctttgtatccttgcaagatgacgattactttgccaccctgagggaactggaagctacccttcggacgcagagcctttctctggcagtgattcctgaagggaaaatcatgaacaacacctactaccaggaatgcctcttctacctgcacaactatagcaccaacctggccatcatcagcttctacgtgaggcacagctgcctgcgggaagctcttctgcaccttctcaacaaggagagtcctccagaagtttttatagaaggcattttccaaccaagctataaaagtgggaagctacacactttggagaacttgctagaatccattgatccaaccttggagagctggggaaagtacttgattgctgcctgccaacatttacagaagaagaactactaccacattctgtatgagctgcagcagtttatgaaggaccaagttcgggccgccatgacctgtattcggttcttcagtcacaaagcaaagtcatatacagaactgggagagaagctctcatggctacttaaggccaaggaccacctgaagatctacctccaagaaacatcccgcagctctggaaggaagaaaaccacattcttcagaaagaagatgactgcagctgatgtgtcaaggcacatgaacacacttcagctgcagatggaagtgaccaggttcttgcatcggtgcgaaagtgctgggacctctcaaatcaccactttgcctctgccaaccctgtttggaaataaccacatgaaaatggatgttgcctgcaaggtcatgctgggagggaaaaatgtagaagatggttttggaattgctttccgtgttctgcaggacttccagctggatgctgccatgacctactgcagagctgcccgccagttggtggagaaagagaagtacagtgagatccagcaactgctcaaatgtgtcagtgagtcaggcatggcagccaaaagtgacggggacaccatcctcctcaactgcctggaagcgttcaagagaattccgccccaggagctggagggcctgatccaggcaatacacaatgatgacaacaaggttcgggcctacctgatatgttgcaaactgcgttctgcctacttgattgctgtgaagcaagaacactcacgggccacagcccttgtccagcaggtgcagcaggccgccaagagcagcggggatgcagtagtgcaagacatctgtgcccagtggcttctgacaagccacccccggggtgcccatggcccaggctccaggaagtgaccttgggcagtggggccaggaacacgtggcctgagagctgggcaacagcagtgatggcgatgccctccacctctttcctccagtggagtgggacttctctggctctgccctaggttggaaagagttggattggaccctacttgccttcccgggcaaggataggacctttcacgcaagtgccatgtttctctaaaattgtggaatctatgtgtgtttgtctggagatggccagttctttctacctcagagtgagtgagtgagtatgtgtgcacacacgtgtgcatgttcctgtgcgctgatgtttacgcccaagcatttctgaacaaatgaaactcttctccatttaaaagaggcactttactttagacttgccactctgaaaaccttccctgcgttttggttc

SEQ ID NO: 204527 - DNA, 7309 bp, Homo sapiens
  Payload ID: 20342
  Gene Name: zinc finger, FYVE domain containing 26
  ENST ID: ENST00000555452
  CDS Start-End: 138-6815
tcggctcaaacatggctgcgctgagagctctattgctttgggcgccgggagcaggaggtactccgcgaatgagaacattgagaatgtgttcggcataactcatttctttgtatctccctgcactctgtgctgggaaaatgaatcatccatttggaaaagaggaagctgcttcgcagaagcagctttttggatttttctgcgaatgcctgcggaggggagaatgggagctggcacaggcatgtgtacctcagctacaggagggacaaggggatatcccaaagagggtagaagacatacttcaggcattggtggtgtgtccaaatctgctgagatgtgggcaggacatcaaccctcaaagagtagcctgggtctggcttcttgtactggagaaatggttggcccgggaaaagaagttactcccagttgttttccggagaaagcttgagtttcttttattgtcagaagacctccaaggtgacattccagagaacatcctcgaggagctgtatgagaccttaacacagggtgcagtaggccacgtgcctgacggaaatccaaggagggagagctggactcctcgtctcagctccgaagctgtctctgtgctctgggatctcctgaggcagtctccccagccagcacaggccctgctggagctcctgcttgaggaggatgacggtactggcctctgtcactggcctctgcagaatgcactggtggacctcattcgaaaggcattgcgggctttgcagggccctgattcggtgccccctggggtagtcgatgccatctatggagccctgcggactctgcgttgccccgcagaaccacttggggttgagttgcatctcctgtgtgaggaactactagaggcctgcaggaccgaggggagtcccctgcgggaggagcggctgctcagctgcctgctgcacaaggccagccggggcctgctgtccctgtatggccatacctatgcagagaaggtcacagaaaagccaccgagggctacagcctcgggaaaagtctcaccggatcatctagatcctgagcgggcaatgctagccctgttctccaatcccaacccagccgaggcttggaaagtggcctatttctactgcctgagcaacaacaaacacttcctcgagcagattctggtaacagcactaacattgttgaaagaagaagacttcccaaatcttggctgcctacttgatagagaattcaggcccctcagttgcctgcttgtactcctgggctggacacactgccagagcctagagtcagccaagaggctgctccagaccctgcacaggacccagggcccaggctgtgatgagctcctcagggatgcctgtgatgggttgtgggctcacctggaggtcctggagtggtgcatacagcagagcagcaaccccataccaaagagagatctgttgtatcatttacacggtggagacagccactcagtgctctacactctccatcaccttacaaaccttccagccctcagggaggaagatgttctcaagctcttacagaaagtgccagccaaggacccccagcaagagcctgatgcagttgatgctccagtccctgagcacctgagccagtgtcagaacctgacactctaccagggcttctgtgccatgaagtatgccatctatgccctctgtgtaaactcacaccagcactcccagtgccaggactgcaaagacagcctctctgaggacctggcctcagctacagagccagcgaatgactctctctcctccccaggtgctgcaaatctcttctcaacttacctggccaggtgtcaacagtatctgtgcagtattcctgactctctgtgcctggagcttctggaaaacatcttctcattgcttctcatcacctctgctgatcttcacccagagcctcacttgcctgaggactatgctgaggatgatgacattgaggggaagagcccctcaggtttgaggtccccatcagagagccctcagcacatagcacatcctgaaaggaagtcagaacggggttccctgggagtcccaaagacccttgcttatacaatgccaagccatgtgaaggcagagccaaaagacagttacccagggcctcataggcacagctttttggacttaaaacactttactagtggtatcagtggatttctggctgatgaatttgcaataggggccttcctcaggcttctccaagagcaactggatgagatcagtagccgcagccctcctgagaagccaaagcaagaaagtcagagctgctcaggaagcagagatggactgcagagccgcctgcatcgactttccaaggttgtctctgaggcccagtggagacacaaggtggtgacaagcaaccatcgttcagaggagcaaccttcccgaagataccagcctgccacacgtcaccccagtctccgccggggtcgtcggacaagaaggagccaggcagatggccgagacagaggttcaaacccatccctggaaagtacaagtagtgagctgagcacaagtacgtcagagggaagtctgagtgccatgtctggccggaatgagctgcacagtagattgcacccccatcctcaaagttcactcatccccatgatgttctccccacctgagtcactgctggcatcctgcatccttcgcgggaacttcgcagaagcccatcaggtgctgttcacgttcaacctgaagtcctcacccagttcaggggaactgatgttcatggagcgctaccaggaagtgatccaagaactggcccaagtagagcacaagattgaaaaccagaactcagatgcgggtagcagcaccattcggagaactggcagtggccgctcaactctacaggccattggcagcgctgcagcagcaggaatggtgttttactctatctctgacgtgactgacaagctgctcaacacctctggagaccccatccccatgctccaggaggacttttggataagcacggctctagtggagcccactgctcccctgagagaggttctggaagacctcagtccccctgccatggctgcatttgacctagcttgctctcagtgccagctctggaaaacctgcaagcagcttttggagacagccgaacggcgtttgaatagtagccttgaaaggcggggtcgacggatagaccacgtactcctaaatgctgatggcattcgaggttttccagttgttcttcagcaaatcagtaagagtctcaattatctgcttatgtcagccagtcaaaccaaatcagagagtgtggaagaaaagggaggaggccctccacggtgcagcatcactgaactgcttcagatgtgctggcccagcctaagcgaggactgtgttgccagccacaccaccctctcccagcagctagatcaggtccttcagtcactgagagaggcactagagctgccagagcccaggactcctccactgtcttccctggtggagcaggcagcccagaaagctccagaggcagaggcccaccctgtgcagatccagactcagctcctccagaagaacctgggcaaacagaccccatcaggcagcaggcagatggactacttgggcaccttcttcagttactgcagcacccttgctgcagttctccttcaaagtttgagctctgagcctgatcatgtggaggtcaaggtaggaaatccctttgttctgctgcaacagagctcttcccaactggtgtcacatctcctgtttgagagacaagttcccccagagagactggcagcccttctggcccaagagaatctcagcctaagtgtgccacaggtcatcgtcagctgctgctgtgagccccttgctctttgctcatcccggcaaagccagcagacctcctccctcctgactcgtctgggtactctggcccagctacacgcctctcactgcctggatgacctcccactttctacaccgagctccccgaggacaactgagaaccctacattggaaagaaagccctactcctccccaagggactcatcactcccagccctcacctcctctgccttggcctttcttaagtcacgctcaaagctcctagctacggtggcctgcctgggggcttccccgaggttaaaggtcagcaaacccagcttgtcatggaaggaacttcgtggccgcagggaggtgcctctggctgcagagcaggtagcccgggagtgtgagcgccttctggaacaattccctctgtttgaggccttcctcctggctgcctgggagcccctgcgagggtctttgcagcaggggcagagtctggcagtgaatctctgtggttgggccagtctttctaccgttctcctgggcctacattctcccattgccctagatgtactgagtgaggcttttgaggaatccttggtggccagagattggtcccgggcccttcagctcactgaagtgtacgggcgagatgtggacgatttgagcagcataaaggatgcagtcctgagctgtgctgtggcatgtgacaaagaaggttggcaatacctgtttcccgtgaaggatgcatctctgagaagtcggctggccctacagtttgtggacaggtggcccctggagtcatgcctggagattctggcctactgcatttcagacacggctgtccaagaaggactaaagtgtgagctacagaggaagctggcggagctgcaggtgtatcagaagattctgggtttgcagtctcccccagtgtggtgtgactggcagaccttgaggagctgttgtgttgaggacccatcaactgtcatgaacatgattctagaagcacaggagtatgaactgtgtgaagagtggggctgcctgtaccccattccaagagaacatttaatcagccttcatcaaaagcatcttctccaccttctagaaagaagagatcatgacaaggctctgcaactcctgcgaagaatccctgaccccaccatgtgccttgaagtgacagagcaatccctcgaccagcacactagcttggccacttctcacttcttggccaactacctcaccacccacttctatggacaactgactgctgtccgacaccgtgaaatccaggcgctgtatgtgggatccaagattctgctgaccctgcctgagcagcaccgggccagctattcccacttgtcctctaaccccctgttcatgctggagcagctgcttatgaacatgaaggtggattgggccactgtggctgtgcagactctccagcagctgctggttggacaggagattggcttcactatggacgaggtggactcactgctttccagatacgcagagaaagccctggactttccataccctcagagggagaaacgatcagattctgtgattcacctccaagaaattgtccaccaggctgcagatcccgagaccctccctagatcaccatcagcagagttctctcctgctgctcctcctggtatctccagtatacattcccctagtctaagggaaaggagtttcccaccaacccagccctcacaggaatttgtgcccccagcgacaccccctgccaggcaccagtgggtaccggatgagactgagagtatctgcatggtctgctgcagggagcacttcaccatgtttaacaggcgtcatcattgtcgccgctgtggccggctagtgtgcagctcctgctccactaagaaaatggtggttgaaggctgcagagagaaccctgctcgtgtgtgtgatcagtgctatagttactgcaacaaagatgtaccagaggagccttcagaaaaaccagaagctctagacagctccaagaatgaaagccctccatactcgtttgtggtgagagtccccaaagcagatgaggtggaatggattttggatctcaaagaggaggaaaatgagctggtgcggagtgaattttactatgagcaggcccccagcgcctccttgtgcattgccatcctgaatctgcaccgggacagcattgcctgtggtcaccagctgattgagcactgctgcaggctctccaagggcctcaccaacccagaggtggatgccgggctgctcacggacatcatgaagcagctgctgttcagcgccaagatgatgttcgtcaaagccggccagagccaagacttggctctttgtgacagctacatcagcaaggtagatgtgctgaatattttagttgctgctgcctatcgccacgtgccatctttggatcagatcttgcagccagctgcagtaaccaggctaaggaaccagcttttggaagccgagtactaccaactgggcgttgaggtctccacaaagactgggcttgataccaccggggcgtggcatgcttggggcatggcctgcctcaaagccgggaacctcactgctgcacgggagaagttcagtcgctgtctgaagcccccatttgacctcaatcagctgaatcatggctcaaggctggtgcaggatgtggttgagtacctagagtccacagtgaggccctttgtatccttgcaagatgacgattactttgccaccctgagggaactggaagctacccttcggacgcagagcctttctctggcagtgattcctgaagggaaaatcatgaacaacacctactaccaggaatgcctcttctacctgcacaactatagcaccaacctggccatcatcagcttctacgtgaggcacagctgcctgcgggaagctcttctgcaccttctcaacaaggtgggacatggacacagctcaaaaaggcagtgcctgccttactcctctggcttggaccactcagccttaagcgggacaataaccccctgacacttaaccctgtgttgagctatggggccatctctagcagagtcaagtcaaaacaggggactctgcacaactgttattcagtgagtgtgaaaagtcttagcctagatcccaaatcactgccctcaccagcaaaggcatgtttcattccttctgccaaaacatgcagcagaatcggatagtggttaagagcatgtctctggaatgagatgctcagtgtgagtcttgtgtggccttgggcatattgcttagagtctgcttccacgcgcctccctacctggcctgggatggtgtccagcttctgacccagctgctggtccattcagagttgttactacaagggccaggaagtaaccatggtgccaatcctatagttgaaccccaaatagatgatgaaagaagaatatgctctcctttttttcttctcccatcctctgcccccctcccactggaagcaaaggcaccactgaagaacattacatctttggagctcttaa

SEQ ID NO: 204528 - DNA, 1533 bp, Homo sapiens
  Payload ID: 20342
  Gene Name: zinc finger, FYVE domain containing 26
  ENST ID: ENST00000557306
  CDS Start-End: 1-984
atgaacaacacctactaccaggaatgcctcttctacctgcacaactatagcaccaacctggccatcatcagcttctacgtgaggcacagctgcctgcgggaagctcttctgcaccttctcaacaaggagagtcctccagaagtttttatagaaggcattttccaaccaagctataaaagtgggaagctacacactttggagaacttgctagaatccattgatccaaccttggagagctggggaaagtacttgattgctgcctgccaacatttacagaagaagaactactaccacattctgtatgagctgcagcagtttatgaaggaccaagttcgggccgccatgacctgtattcggttcttcagtcacaaagcaaagtcatatacagaactgggagagaagctctcatggctacttaaggccaaggaccacctgaagatctacctccaagaaacatcccgcagctctggaaggaagaaaaccacattcttcagaaagaagatgactgcagctgatgtgtcaaggcacatgaacacacttcagctgcagatggaagtgaccaggttcttgcatcggtgcgaaagtgctgggacctctcaaatcaccactttgcctctgccaaccctgtttggaaataaccacatgaaaatggatgttgcctgcaaggtcatgctgggagggaaaaatgtagaagatggttttggaattgctttccgtgttctgcaggacttccagctggatgctgccatgacctactgcagagctgcccgccagttggtggagaaagagaagtacagtgagatccagcaactgctcaaatgtgtcagtgagtcaggcatggcagccaaaagtgacggggacaccatcctcctcaactgcctggaagcgttcaagagaattccgccccaggagctggagggcctgatccaggcaatacacaatgatgacaacaaggtgagcggaattgtctccaaacgctggtgatgccaatgaattgtgtctcaggcttgcctagtcacctttatcccttgctccccacaatagttccatacaacccgtatctcagcttctgtattatcagaggtggagctgaggcttggataggggtgtagaaaggagggaatagatgaggagcaggtgaacatggactgcatgcgtctttgccttcccaagtctttatccccaagacaaacatgtcctaggctgctcttgaatctccattttatactgatgtcttctctcagagagccctaggaaatccctcacctcacctccatctttgggtggactgatggattgaggttcccagagtaagcaggtatctctttatcctagagggaaaaaggtacagtaagaaaaaaatccccaccccacactttgaccaacaatgtccaacaatgtctcggtctccagaatgaacctctcctcaggggccaaagaactcgtccctgtttgggaaaatggtgaacctttgcttcccgttgcctttgggaggagtgccagtcagaataaaaatcttcccagatgccccca

SEQ ID NO: 204529 - DNA, 2927 bp, Homo sapiens
  Payload ID: 20343
  Gene Name: zinc finger, FYVE domain containing 27
  Uniprot ID: Q5T4F4
  ENST ID: ENST00000337540
  CDS Start-End: 203-1321
gcagagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgtcctgctctgcctgggactgagcgagtggacttagggctgggcaggcagtagccaccagagggcagcagcgaactaggccaggcctgactggggtctgaagatcagggtcagtgtggctgtgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttcttgtttttgtc

SEQ ID NO: 204530 - DNA, 2765 bp, Homo sapiens
  Payload ID: 20343
  Gene Name: zinc finger, FYVE domain containing 27
  Uniprot ID: Q5T4F4
  ENST ID: ENST00000357540
  CDS Start-End: 203-1159
gcagagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcagcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgtcctgctctgcctgggactgagcgagtggacttagggctgggcaggcagtagccaccagagggcagcagcgaactaggccaggcctgactggggtctgaagatcagggtcagtgtggctgtgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttcttgtttttgtc

SEQ ID NO: 204531 - DNA, 2997 bp, Homo sapiens
  Payload ID: 20343
  Gene Name: zinc finger, FYVE domain containing 27
  Uniprot ID: Q5T4F4
  ENST ID: ENST00000359980
  CDS Start-End: 188-1402
ggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggtaggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcaggtggcagatgcctttgtgttccttgctgacctgcctgggcctcaacgtcttgttcctcactttgaatgagggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgtcctgctctgcctgggactgagcgagtggacttagggctgggcaggcagtagccaccagagggcagcagcgaactaggccaggcctgactggggtctgaagatcagggtcagtgtggctgtgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttc

SEQ ID NO: 204532 - DNA, 2769 bp, Homo sapiens
  Payload ID: 20343
  Gene Name: zinc finger, FYVE domain containing 27
  Uniprot ID: Q5T4F4
  ENST ID: ENST00000370610
  CDS Start-End: 228-1163
gcagagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggagagtctctcttcccaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgtcctgctctgcctgggactgagcgagtggacttagggctgggcaggcagtagccaccagagggcagcagcgaactaggccaggcctgactggggtctgaagatcagggtcagtgtggctgtgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttcttgtttttgtc

SEQ ID NO: 204533 - DNA, 2669 bp, Homo sapiens
  Payload ID: 20343
  Gene Name: zinc finger, FYVE domain containing 27
  Uniprot ID: Q5T4F4
  ENST ID: ENST00000370613
  CDS Start-End: 203-1063
gcagagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcaggttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgtcctgctctgcctgggactgagcgagtggacttagggctgggcaggcagtagccaccagagggcagcagcgaactaggccaggcctgactggggtctgaagatcagggtcagtgtggctgtgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttcttgtttttgtc

SEQ ID NO: 204534 - DNA, 3047 bp, Homo sapiens
  Payload ID: 20343
  Gene Name: zinc finger, FYVE domain containing 27
  Uniprot ID: Q5T4F4
  ENST ID: ENST00000393677
  CDS Start-End: 205-1440
agagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggtaggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcaggtggcagatgcctttgtgttccttgctgacctgcctgggcctcaacgtcttgttcctcactttgaatgagggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggagacccacttggtggtgctggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgtcctgctctgcctgggactgagcgagtggacttagggctgggcaggcagtagccaccagagggcagcagcgaactaggccaggcctgactggggtctgaagatcagggtcagtgtggctgtgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttcttgtttttgtca

SEQ ID NO: 204535 - DNA, 3045 bp, Homo sapiens
  Payload ID: 20343
  Gene Name: zinc finger, FYVE domain containing 27
  Uniprot ID: Q5T4F4
  ENST ID: ENST00000423811
  CDS Start-End: 200-1450
gattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggtaggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcaggtggcagatgcctttgtgttccttgctgacctgcctgggcctcaacgtcttgttcctcactttgaatgagggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggagagtctctcttcccaggacctcacaccgggcagcgtggaggaggctgaggaggctgagccagatgaagagtttaaagatgcgattgaggagacccacttggtggtgctggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgtcctgctctgcctgggactgagcgagtggacttagggctgggcaggcagtagccaccagagggcagcagcgaactaggccaggcctgactggggtctgaagatcagggtcagtgtggctgtgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttc

SEQ ID NO: 204536 - DNA, 4131 bp, Homo sapiens
  Payload ID: 20344
  Gene Name: zinc finger, FYVE domain containing 28
  Uniprot ID: Q9HCC9
  ENST ID: ENST00000290974
  CDS Start-End: 341-3004
gtgcggcgcggggcggccgtgaccagcggagcgctgggtgtcagtgagcagcgaggagccgcgcgcccccgtgcccgcgtctgtccgtgcgcccgagcgcccactcccgggtctgaggtctgcccggcgcgccgcttgcagagcatactcagggccgcgcacctgccccgcgcacctgcccgccgcccgctcggcgctccgggcttcgctagccagcctccctgcgacagcgcgggggctccggccgtgcctccgcgtccgccccgcgcctcagccgggcccgggcgcagcgctgcggagggcgagggccgcccggagtccggccagggccggcgcggcgatgatgaacaggttccgaaagtggctctacaaacccaagaggtcggatccgcagctgcttgcccggttctactatgccgacgaggagctgaaccaggtggccgcggagctggacagcctggatgggcggaaggacccccagcggtgcacgctgctggtcagccagttccgctcctgtcaggacaatgtgttgaacatcattaaccagatcatggatgagtgcatcccccaggaccgcgcccccagagatttctgcgtcaagttccctgaggagatccggcacgacaacctggccggccagctgtggttcggtgccgagtgcctggccgccggctccatcatcatgaaccgggagctggagagcatggccatgcgcccgctggccaaggagctgacgcgcagcctggaggacgtgcggggcgccctccgtgaccaggcgctgcgggacctgaacacctacacagagaagatgagggaagcgctgaggcacttcgacgtcctgttcgcagagtttgagctcagctacgtctcggccatggtgcctgtgaagtcccccagggagtactacgtgcagcaggaggtcatcgtgctcttctgcgagacggtggagagggccctggacttcgggtacctgactcaggacatgattgatgactacgagccggccctcatgttcagcatccccaggctggccatcgtgtgtggcctcgtggtctatgcggacggacctctgaacttggaccgcaaggtggaagacatgtccgagctgttccggcccttccacacgttgctgcggaaaataagggatttgctgcagacgctgacggaggaggagctgcacacgctggaacggaacctctgcatttcccaagacgtggagttccccatccgcgcagacgtgcagggacccgctgccctggcgcctgccctctctgcccctctcccccctgaggggccactctcagctaaggccaaagacccggatgcagagctggcctgctccatgcagtacgacgaccaggagctggagcagctcagccgcatggtccacagggcgggggacgagatgtcctctttgctttcaccgcccattgcctgccagtccccagctcacaggccaggagcggagggcagcccaggcggggaggcctctccaggtagaccgcgcctgcggtcaggcagtgacgaggaggagcgcgtgttcttcatggatgacgtggaggggacggcagaagccctggccaggcccgagtccccagctggcccatttgggtgggcaggcagtacctgggccgacccccaggagaaagggcagggtgggccaggcggagcggcggggatcagcttgcccgcctcggaaaaggaggaggacttgagcaacaacaatctcgaggccgagggcacagatggggccagcctcgcgggcaccagctcctgcagctgcctggactcgcggctgcacctggacggctgggaggtgggtgcggatgacgcagagacggctgagatgatcgcccaccggacagggggcatgaagctctcagccacggtcatcttcaaccccaaatcgcccacttccctggactctgcggtcgccacccaggaggccgcctcggagcccgtggccgaggggatggatggcggcccccacaagcttagcactggggccaccaactgccttctgcattcctgcgtgtgctgtgggagctgcggggacagcagggaggacgtggtggagcgtctgcgggagaagtgcagcccgggaggcgtcattggtgcctcgtacgctgccggcttagccaaggccagcgacagggcccctgagagacaggaggaggcgcccccaccctcagaagatgcctccaacgggcgggagcccaaagcccccacttccgacaagtgcctgcctcacacctcaggttcccaggtggacacagcgagtgggctgcaaggagaggctggggttgcaggtcagcaggagccagaggccagagagctgcatgctgggagcccctcggctcacgaggcgcctcaggccctgtcgggctccagcagctccacagctgggtcctgctcctcagacaagatggggccagaggcggccccagcagccacgcatgctgccccacaggccacaagagagaagatccggtccaggttccacggcagccacgacctcatccaccgcctgttcgtctgcatttcaggtgtggctgaccagctgcagacgaactatgccagtgacctgagaagtattcttaaaacactgtttgaggtcatggccaccaagcctgaaacagacgacaaggaaaagttaaggaaggtcacccagactctgcggagtgcggccttggaggactgtgcactgtgccaggagaccctgtcatcctctgaactggcagccaagacccgcgatggggactttgaagaccccccggagtgggtgccagacgaggcctgtggcttctgcacggcgtgcaaagcacccttcaccgtcatccgccggaagcaccactgccgcagctgtgggaagatcttctgctcgcgctgctcctcgcactcagcaccgctgccccgctacgggcaggtgaagccggtccgagtgtgcacccactgctacatgttccatgtcacgcccttctacagcgacaaggccggcctgtgacgtggtgccaggggcagccccaacccacccgggccaggaacccccaggaaggtggggccacgctgcaggcaggtctcactgcgtctcatgaggccgctgccgctgctgcaggggcacccagacctccagagcatccagagcctctgtcctgcccacgctagcctccctgcagggaccccgggccggctgcaggggccaacaagaggtcagctttgcccagcaggggacccggaggagcctggtggctgcctcagggcagggtgcctggcggagaaggcctgggccctcccactggtccctcggagatctgctggggctatgggaatcggggcgggtgatggaggtggacaagagtggggccactctgcgcctctgctgttgcggtgaatctggaagccggagcaagggccactccacaggctctttggcacagcagggctccctatgtgcctcccaaacgtcaaatgcaggctacccattctccccatcagctgcccacctcgttccccagccctcacccctcacccctcaccatccttcctcaggacttggctaaacaacatgcatctcatttcttcttggagtggggagatgcgggaagctgacccagtggtcctctaggcaggcagggtgctcctggtgtctgcccaccactgtccccttgctgatggcatgggggtccgaccaggcactgacaccgcaggcagaggttgctcggggccttgggtcgggtttaccaatcagccaggacgcccggggccaccagctcagctaccacttccccttccctctgcaccctctggaaccctggcccaattcctcagaccccagagtggcctgggacccaagctgccgcagctgagtggccccagcggacacctcctcaggcttaaatctcaggcttcacattgcaatgacgattgcagttttatttttggagatgacacacctactgcttcttttctaggataaatctaattactgtttactggtggagtacatatgcatagaaacggcttctgtcggggggagagtatataatggaggaaatattatgtattgagattatatttattttctaaatgctgtaatttgaagccatttccataaatctatttaaggattgc

SEQ ID NO: 204537 - DNA, 1135 bp, Homo sapiens
  Payload ID: 20344
  Gene Name: zinc finger, FYVE domain containing 28
  Uniprot ID: Q9HCC9
  ENST ID: ENST00000509171
  CDS Start-End: 329-847
gcggccgtgaccagcggagcgctgggtgtcagtgagcagcgaggagccgcgcgcccccgtgcccgcgtctgtccgtgcgcccgagcgcccactcccgggtctgaggtctgcccggcgcgccgcttgcagagcatactcagggccgcgcacctgccccgcgcacctgcccgccgcccgctcggcgctccgggcttcgctagccagcctccctgcgacagcgcgggggctccggccgtgcctccgcgtccgccccgcgcctcagccgggcccgggcgcagcgctgcggagggcgagggccgcccggagtccggccagggccggcgcggcgatgatgaacaggttccgaaagtggctctacaaacccaaggacaatgtgttgaacatcattaaccagatcatggatgagtgcatcccccaggaccgcgcccccagagatttctgcgtcaagttccctgaggagatccggcacgacaacctggccggccagctgtggttcggtgccgagtgcctggccgccggctccatcatcatgaaccgggagctggagagcatggccatgcgcccgctggccaaggagctgacgcgcagcctggaggacgtgcggggcgccctccgtgaccaggcgctgcgggacctgaacacctacacagagaagatgagggaagcgctgaggcacttcgacgtcctgttcgcagagtttgagctcagctacgtctcggccatggtgcctgtgaagtcccccagggagtactacgtgcagcaggaggtcatcgtgctcttctgcgagacggtggagagaaatggaaaaggtgttctaaaattcatgtggaactgcaatgggccctaaatagccaaaacaatattgaaaaacaaaaacaaaattggaagattcatacgtcctgatttcaaaacttactacaagtcaaaaccttatggtactggcataaagatagatgtatagaccaatggaataaaattgagaagccataaataaacccaaacatctatggtgaactgattattgacaagggggccaagatcattcaataaggaaagaacagtctcttcagtgaatgttcctggagcaactggataaccacatgcaaaagaacaaagttggaaaaaaaaaaaaaaa

SEQ ID NO: 204538 - DNA, 1874 bp, Homo sapiens
  Payload ID: 20344
  Gene Name: zinc finger, FYVE domain containing 28
  Uniprot ID: Q9HCC9
  ENST ID: ENST00000503000
  CDS Start-End: 287-1150
ggagccgcgcgcccccgtgcccgcgtctgtccgtgcgcccgagcgcccactcccgggtctgaggtctgcccggcgcgccgcttgcagagcatactcagggccgcgcacctgccccgcgcacctgcccgccgcccgctcggcgctccgggcttcgctagccagcctccctgcgacagcgcgggggctccggccgtgcctccgcgtccgccccgcgcctcagccgggcccgggcgcagcgctgcggagggcgagggccgcccggagtccggccagggccggcgcggcgatgatgaacaggttccgaaagtggctctacaaacccaagaggtcggatccgcagctgcttgcccggttctactatgccgacgaggagctgaaccaggtggccgcggagctggacagcctggatgggcggaaggacccccagcggtgcacgctgctggtcagccagttccgctcctgtcaggacaatgtgttgaacatcattaaccagatcatggatgagtgcatcccccaggaccgcgcccccagagatttctgcgtcaagttccctgaggagatccggcacgacaacctggccggccagctgtggttcggtgccgagtgcctggccgccggctccatcatcatgaaccgggagctggagagcatggccatgcgcccgctggccaaggagctgacgcgcagcctggaggacgtgcggggcgccctccgtgaccaggcgctgcgggacctgaacacctacacagagaagatgagggaagcgctgaggcacttcgacgtcctgttcgcagagtttgagctcagctacgtctcggccatggtgcctgtgaagtcccccagggagtactacgtgcagcaggaggtcatcgtgctcttctgcgagacggtggagagggccctggacttcgggtacctgactcaggacatgattgatgactacgagccggccctcatgttcagcatccccaggctggccatcgtgtgccccctccttccagcccatcccagaacacgtgcaggagccaccgcccacgtggcctgcaggatggttgccggatcctcttcaggggccctcacccatccacctgtgtcaaaacaaggtgtcatctctgccctgctcagacccttgccggagctcccaccgtgatctgcctgcaccgtgcccacaccagtcctctctccccagtccccacgcacccgctgccctgggtctccaccatgctgtccccttcgctcagggtccccttgactgtcctatccctactgccacactgtcccctcccccgcactgtccccttttccatgatgtttcctcctccacgctgtcccctctgctccagtgtcctcttggccatgctgtcctctccatggtgctggcccctccactacactgtcccctcctctatgctgtccccttgtctatgctgttccctcctctatgctatcccattctccatgctatcccattctccatgctgtcccctcctccatgctgtcccttcctctgcaatgtcctctcccctgtgctcctctgcactgtcccctcctccatgctgtcccctcctttatgatgttccctcctccgtgctgtcccctccatgatgtcccctcttccgtgctgtcctctcctctgcactgtcccctactccctgctgtacctccctctgcgatgtccccaccactgcaccgctcacccaagccctctcccaccagcaggttgcgtgacttactctgttatttatttttccatgttactgagataaaattcattaccctatgactcacccatctacagtgcacagtcgtttttggtacattcagaattgtgcagccatcaccacaaatttcataacattttcattactcacaaa

SEQ ID NO: 204539 - DNA, 3273 bp, Homo sapiens
  Payload ID: 20344
  Gene Name: zinc finger, FYVE domain containing 28
  Uniprot ID: Q9HCC9
  ENST ID: ENST00000511071
  CDS Start-End: 314-2887
ggagcgctgggtgtcagtgagcagcgaggagccgcgcgcccccgtgcccgcgtctgtccgtgcgcccgagcgcccactcccgggtctgaggtctgcccggcgcgccgcttgcagagcatactcagggccgcgcacctgccccgcgcacctgcccgccgcccgctcggcgctccgggcttcgctagccagcctccctgcgacagcgcgggggctccggccgtgcctccgcgtccgccccgcgcctcagccgggcccgggcgcagcgctgcggagggcgagggccgcccggagtccggccagggccggcgcggcgatgatgaacaggttccgaaagtggctctacaaacccaagaggtcggatccgcagctgcttgcccggttctactatgccgacgaggagctgaaccaggtggccgcggagctggacagcctggatgggcggaaggacccccagcggtgcacgctgctggtcagccagttccgctcctgtcaggacaatgtgttgaacatcattaaccagatcatggatgagtgcatcccccaggaccgcgcccccagagatttctgcgtcaagttccctgaggagatccggcacgacaacctggccggccagctgtggttcggtgccgagtgcctggccgccggctccatcatcatgaaccgggagctggagagcatggccatgcgcccgctggccaaggagctgacgcgcagcctggaggacgtgcggggcgccctccgtgaccaggcgctgcgggacctgaacacctacacagagaagatgagggaagcgctgaggcacttcgacgtcctgttcgcagagtttgagctcagctacgtctcggccatggtgcctgtgaagtcccccagggagtactacgtgcagcaggaggtcatcgtgctcttctgcgagacggtggagagtggcctcgtggtctatgcggacggacctctgaacttggaccgcaaggtggaagacatgtccgagctgttccggcccttccacacgttgctgcggaaaataagggatttgctgcagacgctgacggaggaggagctgcacacgctggaacggaacctctgcatttcccaagacgtggagttccccatccgcgcagacgtgcagggacccgctgccctggcgcctgccctctctgcccctctcccccctgaggggccactctcagctaaggccaaagacccggatgcagagctggcctgctccatgcagtacgacgaccaggagctggagcagctcagccgcatggtccacagggcgggggacgagatgtcctctttgctttcaccgcccattgcctgccagtccccagctcacaggccaggagcggagggcagcccaggcggggaggcctctccaggtagaccgcgcctgcggtcaggcagtgacgaggaggagcgcgtgttcttcatggatgacgtggaggggacggcagaagccctggccaggcccgagtccccagctggcccatttgggtgggcaggcagtacctgggccgacccccaggagaaagggcagggtgggccaggcggagcggcggggatcagcttgcccgcctcggaaaaggaggaggacttgagcaacaacaatctcgaggccgagggcacagatggggccagcctcgcgggcaccagctcctgcagctgcctggactcgcggctgcacctggacggctgggaggtgggtgcggatgacgcagagacggctgagatgatcgcccaccggacagggggcatgaagctctcagccacggtcatcttcaaccccaaatcgcccacttccctggactctgcggtcgccacccaggaggccgcctcggagcccgtggccgaggggatggatggcggcccccacaagcttagcactggggccaccaactgccttctgcattcctgcgtgtgctgtgggagctgcggggacagcagggaggacgtggtggagcgtctgcgggagaagtgcagcccgggaggcgtcattggtgcctcgtacgctgccggcttagccaaggccagcgacagggcccctgagagacaggaggaggcgcccccaccctcagaagatgcctccaacgggcgggagcccaaagcccccacttccgacaagtgcctgcctcacacctcaggttcccaggtggacacagcgagtgggctgcaaggagaggctggggttgcaggtcagcaggagccagaggccagagagctgcatgctgggagcccctcggctcacgaggcgcctcaggccctgtcgggctccagcagctccacagctgggtcctgctcctcagacaagatggggccagaggcggccccagcagccacgcatgctgccccacaggccacaagagagaagatccggtccaggttccacggcagccacgacctcatccaccgcctgttcgtctgcatttcaggtgtggctgaccagctgcagacgaactatgccagtgacctgagaagtattcttaaaacactgtttgaggtcatggccaccaagcctgaaacagacgacaaggaaaagttaaggaaggtcacccagactctgcggagtgcggccttggaggactgtgcactgtgccaggagaccctgtcatcctctgaactggcagccaagacccgcgatggggactttgaagaccccccggagtgggtgccagacgaggcctgtggcttctgcacggcgtgcaaagcacccttcaccgtcatccgccggaagcaccactgccgcagctgtgggaagatcttctgctcgcgctgctcctcgcactcagcaccgctgccccgctacgggcaggtgaagccggtccgagtgtgcacccactgctacatgttccatgtcacgcccttctacagcgacaaggccggcctgtgacgtggtgccaggggcagccccaacccacccgggccaggaacccccaggaaggtggggccacgctgcaggcaggtctcactgcgtctcatgaggccgctgccgctgctgcaggggcacccagacctccagagcatccagagcctctgtcctgcccacgctagcctccctgcagggaccccgggccggctgcaggggccaacaagaggtcagctttgcccagcaggggacccggaggagcctggtggctgcctcagggcagggtgcctggcggagaaggcctgggccctcccactggtccctcggagatctgctggggctatgggaatcggggcgggtgatggaggtggacaagagtggggccactctgcgcctctgctgttgcggtg

SEQ ID NO: 204540 - DNA, 1590 bp, Homo sapiens
  Payload ID: 20344
  Gene Name: zinc finger, FYVE domain containing 28
  Uniprot ID: Q9HCC9
  ENST ID: ENST00000515169
  CDS Start-End: 491-982
gtcacccgctcggaggccgtgggcgccttgacgagggcgcggcggcgggaatgcacaacgttatgctcatcacctgcgtccaccactgtcacccctgacggcgagacgcgaggtgctaagggcttgtccaggctaagcgggttctctgcgtccttaagcccactttgcagatgctaatcagaggggacaggcggccaagaacctggagcccacccgggcgtctgtgcccagtgccgaccgtctaaattcccttcccacgtggctcctgttgcgtctgggctgtggaggattcctctaaacaggcacagccaccctctggaggtcggatccgcagctgcttgcccggttctactatgccgacgaggagctgaaccaggtggccgcggagctggacagcctggatgggcggaaggacccccagcggtgcacgctgctggtcagccagttccgctcctgtcaggacaatgtgttgaacatcattaaccagatcatggatgagtgcatcccccaggaccgcgcccccagagatttctgcgtcaagttccctgaggagatccggcacgacaacctggccggccagctgtggttcggtgccgagtgcctggccgccggctccatcatcatgaaccgggagctggagagcatggccatgcgcccgctggccaaggagctgacgcgcagcctggaggacgtgcggggcgccctccgtgaccaggcgctgcgggacctgaacacctacacagagaagatgagggaagcgctgaggcacttcgacgtcctgttcgcagagtttgagctcagctacgtctcggccatggtgcctgtgaagtcccccagggagtactacgtgcagcaggaggtcatcgtgctcttctgcgagacggtggagagggccctggacttcgggtacctgactcaggacatgattgatgactacgagccggccctcatgttcagcatccccaggctggccatcgtgtgaaatggaaaaggtgttctaaaattcatgtggaactgcaatgggccctaaatagccaaaacaatattgaaaaacaaaaacaaaattggaagattcatacgtcctgatttcaaaacttactacaagtcaaaaccttatggtactggcataaagatagatgtatagaccaatggaataaaattgagaagccataaataaacccaaacatctatggtgaactgattattgacaagggggccaagatcattcaataaggaaagaacagtctcttcagtgaatgttcctggagcaactggataaccacatgcaaaagaacaaagttggaaaaaaaaaaaaaaaagaacaaagttggaccctgcgatggttaacttcatgtgtcatcttgggtaggccacattacccagatatttggtaaaataccagtctgaatgttgctgtgaaggtatttttttttctttttataatgataaactggcaatttataattgcgcagatttatagcatgcaaagttgtgttataatctatgaatgcagtgtggaataattaaatcaagctggttaacatatccatcacctcaaatatttaacatcttttgaatgagatcatttta

SEQ ID NO: 204541 - DNA, 3247 bp, Homo sapiens
  Payload ID: 20344
  Gene Name: zinc finger, FYVE domain containing 28
  Uniprot ID: Q9HCC9
  ENST ID: ENST00000515312
  CDS Start-End: 564-3017
actctcgcgactttgccgcggcgacgtgggggttttatcgcggtatcgcggaacacagcccccgccattcccagtcacccgctcggaggccgtgggcgccttgacgagggcgcggcggcgggaatgcacaacgttatgctcatcacctgcgtccaccactgtcacccctgacggcgagacgcgaggtgctaagggcttgtccaggctaagcgggttctctgcgtccttaagcccactttgcagatgctaatcagaggggacaggcggccaagaacctggagcccacccgggcgtctgtgcccagtgccgaccgtctaaattcccttcccacgtggctcctgttgcgtctgggctgtggaggattcctctaaacaggcacagccaccctctggaggtcggatccgcagctgcttgcccggttctactatgccgacgaggagctgaaccaggtggccgcggagctggacagcctggatgggcggaaggacccccagcggtgcacgctgctggtcagccagttccgctcctgtcaggacaatgtgttgaacatcattaaccagatcatggatgagtgcatcccccaggaccgcgcccccagagatttctgcgtcaagttccctgaggagatccggcacgacaacctggccggccagctgtggttcggtgccgagtgcctggccgccggctccatcatcatgaaccgggagctggagagcatggccatgcgcccgctggccaaggagctgacgcgcagcctggaggacgtgcggggcgccctccgtgaccaggcgctgcgggacctgaacacctacacagagaagatgagggaagcgctgaggcacttcgacgtcctgttcgcagagtttgagctcagctacgtctcggccatggtgcctgtgaagtcccccagggagtactacgtgcagcaggaggtcatcgtgctcttctgcgagacggtggagagggccctggacttcgggtacctgactcaggacatgattgatgactacgagccggccctcatgttcagcatccccaggctggccatcgtgtgtggcctcgtggtctatgcggacggacctctgaacttggaccgcaaggtggaagacatgtccgagctgttccggcccttccacacgttgctgcggaaaataagggatttgctgcagacgctgacggaggaggagctgcacacgctggaacggaacctctgcatttcccaagacgtggagttccccatccgcgcagacgtgcagggacccgctgccctggcgcctgccctctctgcccctctcccccctgaggggccactctcagctaaggccaaagacccggatgcagagctggcctgctccatgcagtacgacgaccaggagctggagcagctcagccgcatggtccacagggcgggggacgagatgtcctctttgctttcaccgcccattgcctgccagtccccagctcacaggccaggagcggagggcagcccaggcggggaggcctctccaggtagaccgcgcctgcggtcaggcagtgacgaggaggagcgcgtgttcttcatggatgacgtggaggggacggcagaagccctggccaggcccgagtccccagctggcccatttgggtgggcaggcagtacctgggccgacccccaggagaaagggcagggtgggccaggcggagcggcggggatcagcttgcccgcctcggaaaaggaggaggacttgagcaacaacaatctcgaggccgagggcacagatggggccagcctcgcgggcaccagctcctgcagctgcctggactcgcggctgcacctggacggctgggaggtgggtgcggatgacgcagagacggctgagatgatcgcccaccggacagggggcatgaagctctcagccacggtcatcttcaaccccaaatcgcccacttccctggactctgcggtcgccacccaggaggccgcctcggagcccgtggccgaggggatggatggcggcccccacaagcttagcactggggccaccaactgccttctgcattcctgcgtgtgctgtgggagctgcggggacagcagggaggacgtggtggagcgtctgcgggagaagtgcagcccgggaggcgtcattggtgcctcgtacgctgccggcttagccaaggccagcgacagggcccctgagagacaggaggaggcgcccccaccctcagaagatgcctccaacgggcgggagcccaaagcccccacttccgacaagtgcctgcctcacacctcaggttcccaggtggacacagcgagtgggctgcaaggagaggctggggttgcaggtcagcaggagccagaggccagagagctgcatgctgggagcccctcggctcacgaggcgcctcaggccctgtcgggctccagcagctccacagctgggtcctgctcctcagacaagatggggccagaggcggccccagcagccacgcatgctgccccacaggccacaagagagaagatccggtccaggttccacggcagccacgacctcatccaccgcctgttcgtctgcatttcaggtgtggctgaccagctgcagacgaactatgccagtgacctgagaagtattcttaaaacactgtttgaggtcatggccaccaagcctgaaacagacgacaaggaaaagttaaggaaggtcacccagactctgcggagtgcggccttggaggactgtgcactgtgccaggagaccctgtcatcctctgaactggcagccaagacccgcgatggggactttgaagaccccccggagtgggtgccagacgaggcctgtggcttctgcacggcgtgcaaagcacccttcaccgtcatccgccggaagcaccactgccgcagctgtgggaagatcttctgctcgcgctgctcctcgcactcagcaccgctgccccgctacgggcaggtgaagccggtccgagtgtgcacccactgctacatgttccatgtcacgcccttctacagcgacaaggccggcctgtgacgtggtgccaggggcagccccaacccacccgggccaggaacccccaggaaggtggggccacgctgcaggcaggtctcactgcgtctcatgaggccgctgccgctgctgcaggggcacccagacctccagagcatccagagcctctgtcctgcccacgctagcctccctgcagggaccccgggccggctgcaggggccaacaagaggtcagctttgcccagcaggggaccc

SEQ ID NO: 204542 - DNA, 541 bp, Homo sapiens
  Payload ID: 20344
  Gene Name: zinc finger, FYVE domain containing 28
  ENST ID: ENST00000508184
  CDS Start-End: 295-541
gtgctgttgacgagagatgtccacgagacagcttccgcagaaaggctgaaaagaaaggggcagaaaaggtgaaccaggcgtttaccaaaagcaaggaggtgaggttctttctccctgtatcagaggtcggatccgcagctgcttgcccggttctactatgccgacgaggagctgaaccaggtggccgcggagctggacagcctggatgggcggaaggacccccagcggtgcacgctgctggtcagccagttccgctcctgtcaggacaatgtgttgaacatcattaaccagatcatggatgagtgcatcccccaggaccgcgcccccagagatttctgcgtcaagttccctgaggagatccggcacgacaacctggccggccagctgtggttcggtgccgagtgcctggccgccggctccatcatcatgaaccgggagctggagagcatggccatgcgcccgctggccaaggagctgacgcgcagcctggaggacgtgcggggcgccctccgtgaccaggcgctgcgggacctgaacacct

SEQ ID NO: 204543 - DNA, 3828 bp, Homo sapiens
  Payload ID: 20344
  Gene Name: zinc finger, FYVE domain containing 28
  ENST ID: ENST00000508471
  CDS Start-End: 2107-2685
agagacctaaagagatcccaagggcgcctgggacaccccttcctccccttagctccagacgtcctggaaatctgtgatgtctgctggcctctgtagagggaacaccagccgcagccacctccacgtcagtcaccgcagagaaaggaagatttgtggaaggaatacagcaaatcaacgcctcctcgcaaagcactttccctggatgttgaaacagtgactgcaaactcagaggcccttcaggggcttaagccaggattcgttcagcccatcctacggctgctgcacgtgaggcccgaggcccttgctgcatctgcactgcacccacgccgctgagaggatctcacttgtctgacccgtcagtggctatcttactgtccgtgtctgtggctcaggcagcaaagctctggaccacataacctgcccagggtcgcccagcgggtgagagatgctcttaggatcagatgacagattccacctctagatgcctgtctggggctgctgtaacagaacacccatgagctgggaggcttaaaaccgtggggatttgctggtttacagttctggaggcaggcatctgagatgagggcgctggtggggtggcactgcagcccaaggttctaggggatgatcctcctgccgcttccagcttctggtggctcctggcacttccttgccttgtggccaagtcactccaagctctgcctccgtcttctcttggcccctcgctgtgtctgtctcttgtaaggatatttattggagttggtatccatccagatagtccaggatggtttcatctcaagatccttaacttaattaaatctgcaaacaacctttttctaaaaaaggtcacagtcgcagattcacattttgggggtcacattcagcccaccgtgacgtctgaatcctgtgcctccagcccctcacccctcccgtcaccccccaccctgtcttcaggacacagcagagagcaggggctggagagtcagcagccaagggctgagctccttccctaatcccacctggcataggtgaactggagaccgcatttgctccaccaagagcccacgtctcagctttgcatcagctagctgggctgtgtataagcaatgccgagtaagggtcctgcagcatccatgcgtcagatgcctgtctcagcacagctgggttctgtgctcagggtctccccaggctgaaatccaggtgctgtggactgcgctctcgtctggagcggctgacgtttatttcatcgcttcttgttgattgagaagagactatgagatgcagttgtggcagggaccgaagtcctgcagcagcaaatctcaggccactgtccctgcaccccctagagtgcctgcatggagcaggtttggaggtgggtgggggagcagtgactgggcccagagtgtctggaaggacccctggacctgtgcccacaccctgagaccggaggaatatggacattggagggtgctccaagacaatgcgccaagaccgggtgacacatccaggagagacctgcggaccaagctagtgcctgcctgtggggaccacagaccccggccagctgaccagggcggggcagccctgagatcccggcttcaatttccctccctcccgctgagctgtttctgggatgggcgcctgccctcctggaccggcccagccctccttcctgtccctcggttctgtccttcattctggcccacagtggcagcggcccttctgaggatgccctggtcacggaacagcattcgtctccttctcagtcccagcctgtgctcaacccaggggctgtggagctgcagtcaggagctgtggtgagaagactgacttccttgggaaggcgagtcacacaggaaaaccacgagagagaatgactttgcaaggggctggagaggaaaggaagcagggagattccagcctgctcagaagaaatcagcttacttgctgctggaagttattagggctgacaccagtgcaaaggcctggcagccacagtggggccggcgccatggcggggtcagcgccacgtgttagttcccccggctgctgtgacgaagcaccgcggcaagcagctccacagctgggtcctgctcctcagacaagatggggccagaggcggccccagcagccacgcatgctgccccacaggccacaagagagaagatccggtccaggttccacggcagccacgacctcatccaccgcctgttcgtctgcatttcaggtgtggctgaccagctgcagacgaactatgccagtgacctgagaagtattcttaaaacactgtttgaggtcatggccaccaagcctgaaacagacgacaaggaaaagttaaggaaggtcacccagactctgcggagtgcggccttggaggactgtgcactgtgccaggagaccctgtcatcctctgaactggcagccaagacccgcgatggggactttgaagaccccccggagtgggtgccagacgaggcctgtggcttctgcacggcgtgcaaagcacccttcaccgtcatccgccggaagcaccactgccgcagctgtgggaagatcttctgctcgcgctgctcctcgcactcagcaccgctgccccgctacgggcaggtgaagccggtccgagtgtgcacccactgctacatgttccatgtcacgcccttctacagcgacaaggccggcctgtgacgtggtgccaggggcagccccaacccacccgggccaggaacccccaggaaggtggggccacgctgcaggcaggtctcactgcgtctcatgaggccgctgccgctgctgcaggggcacccagacctccagagcatccagagcctctgtcctgcccacgctagcctccctgcagggaccccgggccggctgcaggggccaacaagaggtcagctttgcccagcaggggacccggaggagcctggtggctgcctcagggcagggtgcctggcggagaaggcctgggccctcccactggtccctcggagatctgctggggctatgggaatcggggcgggtgatggaggtggacaagagtggggccactctgcgcctctgctgttgcggtgaatctggaagccggagcaagggccactccacaggctctttggcacagcagggctccctatgtgcctcccaaacgtcaaatgcaggctacccattctccccatcagctgcccacctcgttccccagccctcacccctcacccctcaccatccttcctcaggacttggctaaacaacatgcatctcatttcttcttggagtggggagatgcgggaagctgacccagtggtcctctaggcaggcagggtgctcctggtgtctgcccaccactgtccccttgctgatggcatgggggtccgaccaggcactgacaccgcaggcagaggttgctcggggccttgggtcgggtttaccaatcagccaggacgcccggggccaccagctcagctaccacttccccttccctctgcaccctctggaaccctggcccaattcctcagaccccagagtggcctgggacccaagctgccgcagctgagtggccccagcggacacctcctcaggcttaaatctcaggcttcacattgcaatgacgattgcagttttatttttggagatgacacacctactgcttcttttctaggataaatctaattactgtttactggtggagtacatatgcatagaaacggcttctgtcggggggagagtatataatggaggaaatattatgtattgagattatatttattttctaaatgctgtaatttgaagccatttccataaatctatttaaggattgcagacgctctcctttct

SEQ ID NO: 204544 - DNA, 5194 bp, Homo sapiens
  Payload ID: 20345
  Gene Name: zinc finger, FYVE domain containing 9
  Uniprot ID: O95405
  ENST ID: ENST00000287727
  CDS Start-End: 453-4730
acgctggaggcttcgctgaggatccccgcctgccgcacctcggtcgtcccgccgcagccttgcgcccccggcccggctcggcggcgctcctccgggatccgcgtggctgccgcggcccgggcgccgatgcggctgggcgggtgccgggccttagcagcagtagcagccgcagctgcggctaccgcagctcctacaggagtgggaggtttcgcggcggcgcctggggccgcgccggtgccctccggaggaggctttcggctcagggacgacccccgtggccatgctgaagcggaggcggccgctgctcgaggatcaaacagagcatactgaatcagcaggactggctggtggtgcagcagacatcatgagtaagcaccgagaagtctgttccttatcacgtgtgtaaggggaaaaaggtttaaacaagtctcttaagtggtgtttcctcaccgatggagaattacttccaagcagaagcttacaacctggacaaggtgttagatgaatttgaacaaaacgaagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttaaaaggaacttgcattagtgaaagtgaagaatgtgatttctccactgttatagacacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttaaacagcactggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggttttctgtgcttcctgctgtagcctgaaatgtaaactgttatacatggacagaaaggaagctagagtgtgtgtaatctgccattcagtgctaatgaatgctcaagcctgggagaacatgatgagtgcctcaagccagagccctaaccctaacaatcctgctgaatactgttctactatccctcccttgcagcaagctcaggcctcaggagctctgagctctccacctcccactgtgatggtacctgtgggagttttaaagcaccctggagcagaagtggctcagcccagagagcagaggcgagtttggtttgctgatgggatcttgcccaatggagaagttgctgatgcagccaaattaacaatgaatggaacttcctctgcaggaaccctggctgtgtcacacgacccagtcaagccagtaactaccagtcctctaccagcagagacggatatttgtctattctctgggagtataactcaggttggaagtcctgttggaagtgcaatgaatcttattcctgaagatggccttcctcccattctcatctccactggtgtaaaaggagactatgctgtggaagagaaaccatcacagatttcagtaatgcagcagttggaggatggtggccctgacccacttgtatttgttttaaatgcaaatttgttgtcaatggttaaaattgtaaattatgtgaacaggaagtgctggtgtttcacaaccaagggaatgcatgcagtgggtcagtctgagatagtcattcttctacagtgtttaccggatgaaaagtgtttgccaaaggatatctttaatcactttgtgcagctttatcgggatgctctggcagggaatgtggtgagcaacttgggacattccttcttcagtcaaagtttccttggcagtaaagaacatggtggattcttatatgtgacatctacctaccagtcactgcaagacctagtactcccaaccccaccttacttgtttgggattcttatccagaaatgggaaactccttgggctaaagtatttcctatccgtctgatgttgagacttggagctgaatatcgactttatccatgcccactattcagtgtcagatttcggaagccattgtttggagagacggggcataccatcatgaatcttcttgcagacttcagaaattaccagtataccttgccagtagttcaaggtttggtggttgatatggaagttcggaaaactagcatcaaaattcccagcaacagatacaatgagatgatgaaagccatgaacaagtccaatgagcatgtcctggcaggaggtgcctgcttcaatgaaaaggcagactctcatcttgtgtgtgtacagaatgatgatggaaactatcagacccaggctatcagtattcacaatcagcccagaaaagtgactggtgccagtttctttgtgttcagtggcgctctgaaatcctcttctggataccttgccaagtccagtattgtggaagatggtgttatggtccagattactgcagagaacatggattccttgaggcaggcactgcgagagatgaaggacttcaccatcacctgtgggaaggcggacgcggaggaaccccaggagcacatccacatccagtgggtggatgatgacaagaacgttagcaagggtgtcgtaagtcctatagatgggaagtccatggagactataacaaatgtgaagatattccatggatcagaatataaagcaaatggaaaagtaatcagatggacagaggtgtttttcctagaaaacgatgaccagcacaattgcctcagtgatcctgcagatcacagtagattgactgagcatgttgccaaagctttttgccttgctctctgtcctcacctgaaacttctgaaggaagatggaatgaccaaactgggactacgtgtgacacttgactcagatcaggttggctatcaagcagggagcaatggccagccccttccctcgcagtacatgaatgatctggacagcgccttggtgccggtgatccatggaggggcctgccagcttagtgagggccccgttgtcatggaactcatcttttatattctggaaaacatcgtataaacagagaagacttcatttttttctgttcagacttgttgcaacagcagtcatacccaaatcatttgcactttaaaactggaagattaagcttttgttaacactattaatggggtggggaatagggtgggagtgggggtttgggagacgggtgggaaagggtggttggggggaccgatgttccataattctaagtcttctatgcattgtccaccaagaagatctgggcagcttctgttcctgcacaacagttatgctatccttgcagctaatccccttctgttactgtttagacaagaattccgctcctctctcaagatttacttatggtcatgtgctcagaaatgctcaaatgggtacaaccatcaccaagggtgggatgggagggcagaggggaaataaaatataaagcatcagttcttgcactctttgtacagaattggtataaaaaggataattccacactg

SEQ ID NO: 204545 - DNA, 4567 bp, Homo sapiens
  Payload ID: 20345
  Gene Name: zinc finger, FYVE domain containing 9
  Uniprot ID: O95405
  ENST ID: ENST00000357206
  CDS Start-End: 173-4273
atgctgaagcggaggcggccgctgctcgaggatcaaacagagcatactgaatcagcaggactggctggtggtgcagcagacatcatgagtaagcaccgagaagtctgttccttatcacgtgtgtaaggggaaaaaggtttaaacaagtctcttaagtggtgtttcctcaccgatggagaattacttccaagcagaagcttacaacctggacaaggtgttagatgaatttgaacaaaacgaagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttaaaaggaacttgcattagtgaaagtgaagaatgtgatttctccactgttatagacacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttaaacagcactggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggttttctgtgcttcctgctgtagcctgaaatgtaaactgttatacatggacagaaaggaagctagagtgtgtgtaatctgccattcagtgctaatgaatgtggctcagcccagagagcagaggcgagtttggtttgctgatgggatcttgcccaatggagaagttgctgatgcagccaaattaacaatgaatggaacttcctctgcaggaaccctggctgtgtcacacgacccagtcaagccagtaactaccagtcctctaccagcagagacggatatttgtctattctctgggagtataactcaggttggaagtcctgttggaagtgcaatgaatcttattcctgaagatggccttcctcccattctcatctccactggtgtaaaaggagactatgctgtggaagagaaaccatcacagatttcagtaatgcagcagttggaggatggtggccctgacccacttgtatttgttttaaatgcaaatttgttgtcaatggttaaaattgtaaattatgtgaacaggaagtgctggtgtttcacaaccaagggaatgcatgcagtgggtcagtctgagatagtcattcttctacagtgtttaccggatgaaaagtgtttgccaaaggatatctttaatcactttgtgcagctttatcgggatgctctggcagggaatgtggtgagcaacttgggacattccttcttcagtcaaagtttccttggcagtaaagaacatggtggattcttatatgtgacatctacctaccagtcactgcaagacctagtactcccaaccccaccttacttgtttgggattcttatccagaaatgggaaactccttgggctaaagtatttcctatccgtctgatgttgagacttggagctgaatatcgactttatccatgcccactattcagtgtcagatttcggaagccattgtttggagagacggggcataccatcatgaatcttcttgcagacttcagaaattaccagtataccttgccagtagttcaaggtttggtggttgatatggaagttcggaaaactagcatcaaaattcccagcaacagatacaatgagatgatgaaagccatgaacaagtccaatgagcatgtcctggcaggaggtgcctgcttcaatgaaaaggcagactctcatcttgtgtgtgtacagaatgatgatggaaactatcagacccaggctatcagtattcacaatcagcccagaaaagtgactggtgccagtttctttgtgttcagtggcgctctgaaatcctcttctggataccttgccaagtccagtattgtggaagatggtgttatggtccagattactgcagagaacatggattccttgaggcaggcactgcgagagatgaaggacttcaccatcacctgtgggaaggcggacgcggaggaaccccaggagcacatccacatccagtgggtggatgatgacaagaacgttagcaagggtgtcgtaagtcctatagatgggaagtccatggagactataacaaatgtgaagatattccatggatcagaatataaagcaaatggaaaagtaatcagatggacagaggtgtttttcctagaaaacgatgaccagcacaattgcctcagtgatcctgcagatcacagtagattgactgagcatgttgccaaagctttttgccttgctctctgtcctcacctgaaacttctgaaggaagatggaatgaccaaactgggactacgtgtgacacttgactcagatcaggttggctatcaagcagggagcaatggccagccccttccctcgcagtacatgaatgatctggacagcgccttggtgccggtgatccatggaggggcctgccagcttagtgagggccccgttgtcatggaactcatcttttatattctggaaaacatcgtataaacagagaagacttcatttttttctgttcagacttgttgcaacagcagtcatacccaaatcatttgcactttaaaactggaagattaagcttttgttaacactattaatggggtggggaatagggtgggagtgggggtttgggagacgggtgggaaagggtggttggggggaccgatgttccataattctaagtcttctatgcattgtccaccaagaagatctgggcagcttctgttcctgcacaacagttatgctatccttgcagctaatccccttctgttactgtttagacaa

SEQ ID NO: 204546 - DNA, 4874 bp, Homo sapiens
  Payload ID: 20345
  Gene Name: zinc finger, FYVE domain containing 9
  Uniprot ID: O95405
  ENST ID: ENST00000371591
  CDS Start-End: 132-4409
gcatactgaatcagcaggactggctggtggtgcagcagacatcatgagtaagcaccgagaagtctgttccttatcacgtgtgtaaggggaaaaaggtttaaacaagtctcttaagtggtgtttcctcaccgatggagaattacttccaagcagaagcttacaacctggacaaggtgttagatgaatttgaacaaaacgaagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttaaaaggaacttgcattagtgaaagtgaagaatgtgatttctccactgttatagacacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttaaacagcactggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggttttctgtgcttcctgctgtagcctgaaatgtaaactgttatacatggacagaaaggaagctagagtgtgtgtaatctgccattcagtgctaatgaatgctcaagcctgggagaacatgatgagtgcctcaagccagagccctaaccctaacaatcctgctgaatactgttctactatccctcccttgcagcaagctcaggcctcaggagctctgagctctccacctcccactgtgatggtacctgtgggagttttaaagcaccctggagcagaagtggctcagcccagagagcagaggcgagtttggtttgctgatgggatcttgcccaatggagaagttgctgatgcagccaaattaacaatgaatggaacttcctctgcaggaaccctggctgtgtcacacgacccagtcaagccagtaactaccagtcctctaccagcagagacggatatttgtctattctctgggagtataactcaggttggaagtcctgttggaagtgcaatgaatcttattcctgaagatggccttcctcccattctcatctccactggtgtaaaaggagactatgctgtggaagagaaaccatcacagatttcagtaatgcagcagttggaggatggtggccctgacccacttgtatttgttttaaatgcaaatttgttgtcaatggttaaaattgtaaattatgtgaacaggaagtgctggtgtttcacaaccaagggaatgcatgcagtgggtcagtctgagatagtcattcttctacagtgtttaccggatgaaaagtgtttgccaaaggatatctttaatcactttgtgcagctttatcgggatgctctggcagggaatgtggtgagcaacttgggacattccttcttcagtcaaagtttccttggcagtaaagaacatggtggattcttatatgtgacatctacctaccagtcactgcaagacctagtactcccaaccccaccttacttgtttgggattcttatccagaaatgggaaactccttgggctaaagtatttcctatccgtctgatgttgagacttggagctgaatatcgactttatccatgcccactattcagtgtcagatttcggaagccattgtttggagagacggggcataccatcatgaatcttcttgcagacttcagaaattaccagtataccttgccagtagttcaaggtttggtggttgatatggaagttcggaaaactagcatcaaaattcccagcaacagatacaatgagatgatgaaagccatgaacaagtccaatgagcatgtcctggcaggaggtgcctgcttcaatgaaaaggcagactctcatcttgtgtgtgtacagaatgatgatggaaactatcagacccaggctatcagtattcacaatcagcccagaaaagtgactggtgccagtttctttgtgttcagtggcgctctgaaatcctcttctggataccttgccaagtccagtattgtggaagatggtgttatggtccagattactgcagagaacatggattccttgaggcaggcactgcgagagatgaaggacttcaccatcacctgtgggaaggcggacgcggaggaaccccaggagcacatccacatccagtgggtggatgatgacaagaacgttagcaagggtgtcgtaagtcctatagatgggaagtccatggagactataacaaatgtgaagatattccatggatcagaatataaagcaaatggaaaagtaatcagatggacagaggtgtttttcctagaaaacgatgaccagcacaattgcctcagtgatcctgcagatcacagtagattgactgagcatgttgccaaagctttttgccttgctctctgtcctcacctgaaacttctgaaggaagatggaatgaccaaactgggactacgtgtgacacttgactcagatcaggttggctatcaagcagggagcaatggccagccccttccctcgcagtacatgaatgatctggacagcgccttggtgccggtgatccatggaggggcctgccagcttagtgagggccccgttgtcatggaactcatcttttatattctggaaaacatcgtataaacagagaagacttcatttttttctgttcagacttgttgcaacagcagtcatacccaaatcatttgcactttaaaactggaagattaagcttttgttaacactattaatggggtggggaatagggtgggagtgggggtttgggagacgggtgggaaagggtggttggggggaccgatgttccataattctaagtcttctatgcattgtccaccaagaagatctgggcagcttctgttcctgcacaacagttatgctatccttgcagctaatccccttctgttactgtttagacaagaattccgctcctctctcaagatttacttatggtcatgtgctcagaaatgctcaaatgggtacaaccatcaccaagggtgggatgggagggcagaggggaaataaaatataaagcatcagttcttgcactctttgtacagaattggtataaaaaggataattccacactga

SEQ ID NO: 204547 - DNA, 2303 bp, Homo sapiens
  Payload ID: 20346
  Gene Name: zinc finger, GATA-like protein 1
  Uniprot ID: P0C6A0
  ENST ID: ENST00000403903
  CDS Start-End: 1200-2015
aaacaaaaacaaaccacacctgcatctgctgtgctgggcccccggttctcttttccctctgggatctaagatgccgctggggatccaaggcagaggcctgggagcccccatttccgagggggagggctagcgtggaaggccccgccccggcagctgcggagggatttggtggggtccaggccgcccttgccacgcaggggtgcgcggatgacctgaaaaaagccagaaagaggaaaggtgccgccgaggctggtcgctctcagctggggctcatcgcatcctctaccaagagcgctcccaccacacaggtcccgcccctcccaggtgggtttcatcgggtgggcccagcgggacagggccgggtgaaattagggagggggctgggctggggcgcaatggaggccgagccaatcccggactcctcaatgccagcaaagcttctggcgccgccctgtctgaacctggagcggctgggaggatccccctcccaggagaagccgaggaccccaggatgctgcagaatcagtgagaggtgcgtaaggccaaaccccattccccggaccccgctagcacttcaccacctggctcagtgatcaaggggtcatgacctctctttgctggggttatcgagaagtggcaattttataatagttactgaaacttacaaagaggttctggtgcccagagacacttggggtcatctagggatcagaggccatgcaattccatgtctctggggctgatgtaggcactccccagggatcatccaggggttatggagggcaactcaataataatgaaaatgataaaaatcgtaatcatattatggcaagccagcggcgtggtggcgcgtgcctgtaagtcccagctactcgggaggctgaggcggaaggatcggtcgagcccaggagttctaggctgcactgagtcctgatcacgcccctgcactccaggcgggggtacagagtgaggctcggtctctaaaagaaacacaaagaaaaaaagtaacctttttctcgatcctgcagccagaggcttgatatcctgcctcggtcacctagggcggtccctgcctgggtgatctacgggtgccgtaaggggttgattgatgtggagggctgggcgtgcctgggaggcccacagtgggcgaggtgagttgcaattactgcaactcttaaaccttccacccagagttagaaatgactgaacctcaggtggggtgtgtagcctgtccaagggtacacaaagagccggcccaagttggaaccccctggccggctaaacccaggagtcacccaagaaaacgtgaccccactgcccttctccccaggtccctctggcctgcatgccaggagtcggtcaccgccctgtgcttcctccaagagacagtggagaggctgggtcagtcccctgcccaggacaccccggtcctggggccttgctgggacccgatggctctggggactcagggccgcctgctgctggacagggattccaaggacacacagaccaggatcagccaaaagggccgccgtctgcagcccccggggactccctcggccccaccccagagaaggccccggaaacagctgaacccctgccggggcaccgagagagtggaccctgggttcgagggggtgactctgaagtttcagataaagccggactccagcctgcagatcatccccacgtacagcctgccctgcagtagccgttctcaggaatcccctgcagatgctgttgggggccctgcagcccacccaggaggcaccgaggcccactcagcaggcagcgaggccctggagccccggcgctgtgcttcctgtcggacccagaggaccccgctctggagagacgctgaagatgggacccctctctgcaacgcctgtgggatcaggtacaagaaatacggcactcgctgctccagctgctggctggtgcccaggaaaaatgtccagcccaagaggctatgtggcagatgtggagtgtccctggaccccattcaggaaggttaaacccagcttcaccctgctgagctgctgcttctgcctccgtttcaccagtgggagaatgggcagaagcagctctcctaggaggattggggaaagagccggcctgcctcctctctgccatctccagattcaaggatcccgggggaagacccaggcctcaggtggcagagcctgctaggggtcaccagccccttctccagtcagccttggccgaggccccctcaggagacgctctcaggaaggatgagcattgttacagcagggacaataaagtacagagatatgccgaga

SEQ ID NO: 204548 - DNA, 1028 bp, Homo sapiens
  Payload ID: 20346
  Gene Name: zinc finger, GATA-like protein 1
  ENST ID: ENST00000403352
  CDS Start-End: 449-1012
ctgggagcccccatttccgagggggagggctagcgtggaaggccccgccccggcagctgcggagggatttggtggggtccaggccgcccttgccacgcaggggtgcgcggatgacctgaaaaaagccagaaagaggaaaggtgccgccgaggctggtcgctctcagctggggctcatcgcatcctctaccaagagcgctcccaccacacaggtcccgcccctcccagcaaagcttctggcgccgccctgtctgaacctggagcggctgggaggatccccctcccaggagaagccgaggaccccaggatgctgcagaatcagtgagaggtccctctggcctgcatgccaggagtcggtcaccgccctgtgcttcctccaagagacagtggagaggctgggtcagtcccctgcccaggacaccccggtcctggggccttgctgggacccgatggctctggggactcagggccgcctgctgctggacagggattccaaggacacacagaccaggatcagccaaaagggccgccgtctgcagcccccggggactccctcggccccaccccagagaaggccccggaaacagctgaacccctgccggggcaccgagagagtggaccctgggttcgagggggtgactctgaagtttcagataaagccggactccagcctgcagatcatccccacgtacagcctgccctgcagtagccgttctcaggaatcccctgcagatgctgttgggggccctgcagcccacccaggaggcaccgaggcccactcagcaggcagcgaggccctggagccccggcgctgtgcttcctgtcggacccagaggaccccgctctggagagacgctgaagatgggacccctctctgcaacgcctgtgggatcaggtacaagaaatacggcactcgctgctccagctgctggctggtgcccaggaaaaatgtccagcccaagaggctatgtggcagatgtggagtgtccctggaccccattcaggaaggttaaacccagcttcaccctg

SEQ ID NO: 204549 - DNA, 3347 bp, Homo sapiens
  Payload ID: 20347
  Gene Name: zinc finger, GRF-type containing 1
  Uniprot ID: Q86YA3
  ENST ID: ENST00000309071
  CDS Start-End: 127-3315
taatgacgtcacgttgtttcgcgggagaaattcgaaagtggattttgtgcaatttgacaggtggtataaatagttgaatatttcctattttctggacccagctggtttataacttcagaagaaataatggaaagccaagaatttattgttctatatactcatcaaaagatgaagaagtcaaaagtgtggcaagatggaattctgaagatcactcacttaggaaacaaagcaattttatatgatgacaaaggagcatgtttggagagtctgtttcttaaatgccttgaggtgaaacctggagatgacttagaaagtgatcgatacttaatcacagttgaagaggttaaagttgctggagccataggtattgttaagcagaatgtcaataaagaagcaccagagttaaattcaaggacatttatatcctctggccgatctcttggatgtcagccctctggcttaaaaaggaagtttactggttttcaaggaccacgtcaggttccaaagaaaatggttattatggaaagtggtgaatcagctgcatcacatgaggctaagaaaactggccctactattttttctccattctgcagcatgcctcctttgtttcctactgttggcaagaaagatgtaaataatatactggcagaccctgagaacattgtgacttacaagaacagggagagaaatgccatggatttttcttcggttttttctccatccttccagattaacccagaagtgctgtgtgaagaaaattatttttgctcacctgtcaattctggaaataagctttcagactctttactgaccaatgagcctgtgaaaagagatagtttggcatctcactattcaggagtttcacaaaacatcagaagcaaagcacagatattagctcttctgaagtccgaatcatctagttcatgtgaggaactaaattctgagatgacagagcattttcctcaaaaacaaccacaaggaagtttaaaaattgctactaaaccaaagtacctaattcaacaggaagagtgtgctgagatgaagagcacagaaaatttatactaccagcatcaatcagaaaataccatgagaaataaaagccggtgggccatgtatttatcctcacagagttcacctatacattcttctactgtagatgggaatgatacagaaaggaaacccaaggcccaggaagatgatgtaaattctaatttgaaagacctttcattacaaaaaattatacagttcgttgaaacgtatgctgaagagaggaaaaagtataatgtagaccagtcagtcggtaataatgatccatcctggaatcaggaagtaaaattagaaattccttcattcaatgaaagcagtagcttacaggttacttgtagcagtgcagaaaatgatggtatattatcagaatctgacattcaagaagataataaaataccttttaatcaaaatgacaaggggtgcattaaaggatcagttctcattaaagaaaatgctcaggaggtaaatacatgtggaacactggaaaaggagtatgaacaatcagagtcatctctgccagaactgaaacatctccaaattgaatctagtaataattctaggatctctgatgacattacagacatgatttctgaaagtaaaatggataatgaaagtcttaatagtattcatgaatctctgagtaatgtaacacaaccatttttggaggtaacttttaatctgaacaattttgagaccagtgacactgaggaggaatcacaggaaagcaacaaaatttcccaggattcagagagttgggtaaaggacattttggttaatgatggcaattcatgttttcaaaagaggtctgagaatacaaactgtgaagagattgagggtgaacatttgccattcttaacatctgttagtgacaaacctacagtgacatttcctgttaaagagactctgccatcacagttttgtgataaaacttatgtgggttttgacatgggaatatgtaaaactgaaaacacaggaaaagaaatagaggagtatagtgacacattaagcaattttgaatctttcaagtggactgatgctgtatacggagataataaagaagatgctaataaacctattcaagaagtcagaattaactatgattttgctttacccccgaataaatctaaaggtataaacatgaatttacatattcctcatattcaaaaccagattgctgaaaacagtaatctattttcagaagatgctcaacctcagccttttattttgggaagtgacttagacaaaaatgatgaacatgttttaccctcaacttctagtagtgacaacagtgtccaactattaaataccaatcagaatcactatgaatgtattgcacttgataaatcaaatacccacatttccaattctttgttttacccactgggaaaaaagcatcttatttccaaagacacagaagcacatatatctgaacctgaagatttgggaaagattagaagtccaccccctgaccatgttgaggttgaaactgccagagaaggcaaacaatactggaatcctagaaattcttcagaactttctggattagtaaataccatttctattttaaagtcgctatgtgaacacagtactgctttagacagcttggaaatattgaaaaagaaaaatactgtctttcagcaaggaactcaacagacgtatgagccagatagccctcctgaagtgaggaaaccatttattacagtagtttcaccaaagtctcctcatctgcacaaggattctcaacagatactaaaagaagatgaagttgaactaagtgaaccacttcagtctgtgcagttctcttcctcgggaagtaaagaagagactgcttttcaagctgttattcctaaacaaatagagagaaaaacctgtgaccctaagcctgttgagtttcaaggacatcaagtaaaaggatcagctactagtggtgtaatggtcagaggacacagctcacagctaggatgcagtcagtttccagatagcactgagtatgaaaactttatgacagagacaccagagttacctagcacgtgtatgcagattgacttcttgcaggtgacatcaccagaagaaaacatctctacattgagccctgtttctaccttttctttgaactcaagagatgaagacttcatggtagaattctctgagacgtccctgaaagcaagaactttacctgatgatcttcattttctcaacttggagggtagtcgttaccacattgctctaatatctgtctattcatttaagatgaagttttttatttgagagattattacactaaatatatcttagaacca

SEQ ID NO: 204550 - DNA, 6529 bp, Homo sapiens
  Payload ID: 20347
  Gene Name: zinc finger, GRF-type containing 1
  Uniprot ID: Q86YA3
  ENST ID: ENST00000445203
  CDS Start-End: 1-6315
atggaaagccaagaatttattgttctatatactcatcaaaagatgaagaagtcaaaagtgtggcaagatggaattctgaagatcactcacttaggaaacaaagcaattttatatgatgacaaaggagcatgtttggagagtctgtttcttaaatgccttgaggtgaaacctggagatgacttagaaagtgatcgatacttaatcacagttgaagaggttaaagttgctggagccataggtattgttaagcagaatgtcaataaagaagcaccagagttaaattcaaggacatttatatcctctggccgatctcttggatgtcagccctctggcttaaaaaggaagtttactggttttcaaggaccacgtcaggttccaaagaaaatggttattatggaaagtggtgaatcagctgcatcacatgaggctaagaaaactggccctactattttttctccattctgcagcatgcctcctttgtttcctactgttggcaagaaagatgtaaataatatactggcagaccctgagaacattgtgacttacaagaacagggagagaaatgccatggatttttcttcggttttttctccatccttccagattaacccagaagtgctgtgtgaagaaaattatttttgctcacctgtcaattctggaaataagctttcagactctttactgaccaatgagcctgtgaaaagagatagtttggcatctcactattcaggagtttcacaaaacatcagaagcaaagcacagatattagctcttctgaagtccgaatcatctagttcatgtgaggaactaaattctgagatgacagagcattttcctcaaaaacaaccacaaggaagtttaaaaattgctactaaaccaaagtacctaattcaacaggaagagtgtgctgagatgaagagcacagaaaatttatactaccagcatcaatcagaaaataccatgagaaataaaagccggtgggccatgtatttatcctcacagagttcacctatacattcttctactgtagatgggaatgatacagaaaggaaacccaaggcccaggaagatgatgtaaattctaatttgaaagacctttcattacaaaaaattatacagttcgttgaaacgtatgctgaagagaggaaaaagtataatgtagaccagtcagtcggtaataatgatccatcctggaatcaggaagtaaaattagaaattccttcattcaatgaaagcagtagcttacaggttacttgtagcagtgcagaaaatgatggtatattatcagaatctgacattcaagaagataataaaataccttttaatcaaaatgacaaggggtgcattaaaggatcagttctcattaaagaaaatgctcaggaggtaaatacatgtggaacactggaaaaggagtatgaacaatcagagtcatctctgccagaactgaaacatctccaaattgaatctagtaataattctaggatctctgatgacattacagacatgatttctgaaagtaaaatggataatgaaagtcttaatagtattcatgaatctctgagtaatgtaacacaaccatttttggaggtaacttttaatctgaacaattttgagaccagtgacactgaggaggaatcacaggaaagcaacaaaatttcccaggattcagagagttgggtaaaggacattttggttaatgatggcaattcatgttttcaaaagaggtctgagaatacaaactgtgaagagattgagggtgaacatttgccattcttaacatctgttagtgacaaacctacagtgacatttcctgttaaagagactctgccatcacagttttgtgataaaacttatgtgggttttgacatgggaatatgtaaaactgaaaacacaggaaaagaaatagaggagtatagtgacacattaagcaattttgaatctttcaagtggactgatgctgtatacggagataataaagaagatgctaataaacctattcaagaagtcagaattaactatgattttgctttacccccgaataaatctaaaggtataaacatgaatttacatattcctcatattcaaaaccagattgctgaaaacagtaatctattttcagaagatgctcaacctcagccttttattttgggaagtgacttagacaaaaatgatgaacatgttttaccctcaacttctagtagtgacaacagtgtccaactattaaataccaatcagaatcactatgaatgtattgcacttgataaatcaaatacccacatttccaattctttgttttacccactgggaaaaaagcatcttatttccaaagacacagaagcacatatatctgaacctgaagatttgggaaagattagaagtccaccccctgaccatgttgaggttgaaactgccagagaaggcaaacaatactggaatcctagaaattcttcagaactttctggattagtaaataccatttctattttaaagtcgctatgtgaacacagtactgctttagacagcttggaaatattgaaaaagaaaaatactgtctttcagcaaggaactcaacagacgtatgagccagatagccctcctgaagtgaggaaaccatttattacagtagtttcaccaaagtctcctcatctgcacaaggattctcaacagatactaaaagaagatgaagttgaactaagtgaaccacttcagtctgtgcagttctcttcctcgggaagtaaagaagagactgcttttcaagctgttattcctaaacaaatagagagaaaaacctgtgaccctaagcctgttgagtttcaaggacatcaagtaaaaggatcagctactagtggtgtaatggtcagaggacacagctcacagctaggatgcagtcagtttccagatagcactgagtatgaaaactttatgacagagacaccagagttacctagcacgtgtatgcagattgacttcttgcaggtgacatcaccagaagaaaacatctctacattgagccctgtttctaccttttctttgaactcaagagatgaagacttcatggtagaattctctgagacgtccctgaaagcaagaactttacctgatgatcttcattttctcaacttggaggggatgaaaaaatcccgttctctggagaatgagaaccttcaaaggctttcattattaagtagaacccaggttccacttattactttgccacgtactgatgggccacctgacttagactctcattcgtatatgatcaactctaacacatacgagtcttctggctcccccatgctcaatttgtgtgaaaagtcagcagttctttcgtttagcattgagcctgaggaccaaaatgaaacctttttctctgaagaatctagggaagtgaatccaggggatgtttcacttaataatatatctactcagagcaagtggctgaaatatcaaaacacatcccaatgcaacgtggctactccaaacagagttgataagagaataactgatggcttctttgctgaggctgtttctgggatgcattttagagacacaagtgaaagacagagtgatgctgtcaatgaaagctctttagactctgtgcatttgcaaatgataaaaggcatgctctatcaacagcggcaggattttagcagtcaagattcggtttccagaaagaaagtactttctctgaatttaaagcagacttctaagacagaggaaattaaaaatgtattaggagggtctacctgctacaactacagtgtaaaggatttacaggagataagtggctctgagctgtgctttccaagtgggcagaaaataaaatctgcttatcttccccaaaggcaaattcacataccagctgtttttcagtctcctgctcattataagcagactttcacatcttgcctcatagaacatctaaatatattgctgtttgggttagcacaaaacctgcagaaagctctttcaaaagttgacatatcattttatacatcattgaagggagagaaactgaaaaacgcagaaaataatgtaccatcctgccatcatagtcaacctgcaaaacttgtcatggttaaaaaggaaggtccaaataagggtcgtctcttttatacatgtgatggacccaaagctgatcgatgtaaattctttaaatggcttgaggacgtgactccaggatattcaacacaggaaggagctcgacctggcatggttttaagtgatattaagagtattggcttatatttaagaagtcaaaagataccactttatgaggaatgccagcttttggtgagaaaaggatttgattttcagagaaaacagtatggcaaactaaagaagtttactactgtaaatcctgagttttataatgaaccaaaaaccaaactttatcttaagctaagtcggaaggaaagatcttcagcttatagcaaaaatgatctttgggtggtttcaaaaaccctagactttgagctggatacttttatcgcatgtagtgctttctttggaccatcatctatcaatgagatagaaatactgcctttgaaaggctatttcccttctaattggcccactaacatggttgtccatgcgttattggtttgtaatgctagcacagaactgactactttgaaaaacattcaggactactttaatccagctactctacctctaacacagtacctgttaacaacgtcttcgccaactatagttagtaacaaaagagtcagtaagagaaaatttatcccaccagccttcacaaatgtcagtacaaaatttgaactactcagcctaggagcaacattgaagttagctagtgagttgattcaggtacacaagttaaacaaggatcaagctacagctctaattcaaatagctcaaatgatggcatcacatgaaagcattgaagaagtgaaggaactgcaaactcataccttccctatcacaatcatacatggtgtgtttggagcaggaaagagttacttgctggcagtggtgattttgttctttgtacagctgtttgaaaagagtgaagctcccaccattggaaatgcaaggccgtggaaacttctgatttcttcttctactaatgtggctgttgacagagtacttcttgggcttctcagtcttggatttgaaaactttatcagagttgggagtgttaggaagattgccaaaccaattttaccttatagcttgcatgctggctcagaaaatgaaagtgaacagttaaaagaactacatgcactaatgaaagaagacctgactcctacggaaagagtctatgtgagaaaaagcattgagcagcataaactggggaccaatagaaccctgctgaagcaggttcgagtagttggagttacctgtgcagcctgcccattcccatgcatgaatgatcttaaatttcctgtagttgtgctggatgagtgtagtcagataactgaaccggcctctctccttcccattgcaaggtttgagtgtgaaaagctgattcttgttggggatcccaaacagctacctcctactattcagggttctgatgcagctcatgaaaatggattggaacaaactctttttgatcgactttgcttaatgggtcacaagccaattctattgagaactcaataccgttgtcatcctgcaatcagtgctattgctaatgatctgttttacaaaggagccctcatgaatggtgtaacagaaatagagcggagccctttattggaatggctaccaaccctgtgtttttataatgttaaaggactagaacagatagaaagagataacagctttcataatgtggcagaagctacgtttacactcaagctgattcaatcactgattgcaagtggaatagcaggctctatgattggtgtgataacattatacaaatcccagatgtacaagctttgtcatttactcagtgctgtggactttcaccatcctgatattaaaactgtgcaggtgtccacagtagatgcttttcagggagctgaaaaggagatcattattctgtcctgtgtaaggacaagacaagtaggattcattgattcagaaaaaagaatgaatgttgcattgactagaggaaagaggcatttgttgattgtgggaaatttagcctgtttgaggaaaaatcaactttggggacgagtgatccaacactgcgaaggaagggaagatggattgcaacatgcaaaccagtatgaaccacagctgaaccatctccttaaagattattttgaaaaacaagtggaagaaaaacagaagaaaaagagtgaaaaagagaaatctaaagataaatctcattcataaaaagacatggtgtaaatattttgtatttatgtaaattcagactcattttacatgatatattttttatatttttattactctaaaccctcttattaaaaatatgatatttaaataacatagtaaacacatgtaaaaattttgttcttcaaaaaagtgtacaaaaggtagtataaaatcctactaataaaaataagcttttttctaagaagaatga

SEQ ID NO: 204551 - DNA, 3089 bp, Homo sapiens
  Payload ID: 20347
  Gene Name: zinc finger, GRF-type containing 1
  ENST ID: ENST00000445413
  CDS Start-End: 1-2046
tgtgaaaagtcagcagttctttcgtttagcattgagcctgaggaccaaaatgaaacctttttctctgaagaatctagggaagtgaatccaggggatgtttcacttaataatatatctactcagagcaagtggctgaaatatcaaaacacatcccaatgcaacgtggctactccaaacagagttgataagagaataactgatggcttctttgctgaggctgtttctgggatgcattttagagacacaagtgaaagacagagtgatgctgtcaatgaaagctctttagactctgtgcatttgcaaatgataaaaggcatgctctatcaacagcggcaggattttagcagtcaagattcggtttccagaaagaaagtactttctctgaatttaaagcagacttctaagacagaggaaattaaaaatgtattaggagggtctacctgctacaactacagtgtaaaggatttacaggagataagtggctctgagctgtgctttccaagtgggcagaaaataaaatctgcttatcttccccaaaggcaaattcacataccagctgtttttcagtctcctgctcattataagcagactttcacatcttgcctcatagaacatctaaatatattgctgtttgggttagcacaaaacctgcagaaagctctttcaaaagttgacatatcattttatacatcattgaagggagagaaactgaaaaacgcagaaaataatgtaccatcctgccatcatagtcaacctgcaaaacttgtcatggttaaaaaggaaggtccaaataagggtcgtctcttttatacatgtgatggacccaaagctgatcgatgtaaattctttaaatggcttgaggacgtgactccaggatattcaacacaggaaggagctcgacctggcatggttttaagtgatattaagagtattggcttatatttaagaagtcaaaagataccactttatgaggaatgccagcttttggtgagaaaaggatttgattttcagagaaaacagtatggcaaactaaagaagtttactactgtaaatcctgagttttataatgaaccaaaaaccaaactttatcttaagctaagtcggaaggaaagatcttcagcttatagcaaaaatgatctttgggtggtttcaaaaaccctagactttgagctggatacttttatcgcatgtagtgctttctttggaccatcatctatcaatgagatagaaatactgcctttgaaaggctatttcccttctaattggcccactaacatggttgtccatgcgttattggtttgtaatgctagcacagaactgactactttgaaaaacattcaggactactttaatccagctactctacctctaacacagtacctgttaacaacgtcttcgccaactatagttagtaacaaaagagtcagtaagagaaaatttatcccaccagccttcacaaatgtcagtacaaaatttgaactactcagcctaggagcaacattgaagttagctagtgagttgattcaggtacacaagttaaacaaggatcaagctacagctctaattcaaatagctcaaatgatggcatcacatgaaagcattgaagaagtgaaggaactgcaaactcataccttccctatcacaatcatacatggtgtgtttggagcaggaaagagttacttgctggcagtggtgattttgttctttgtacagctgtttgaaaagagtgaagctcccaccattggaaatgcaaggccgtggaaacttctgatttcttcttctactaatgtggctgttgacagagtacttcttgggcttctcagtcttggatttgaaaactttatcagagttgggagtgttaggaagattgccaaaccaattttaccttatagcttgcatgctggctcagaaaatgaaagtgaacagttaaaagaactacatgcactaatgaaagaagacctgactcctacggaaagagtctatgtgagaaaaagcattgagcagcataaactggggaccaatagaaccctgctgaagcaggtttgagtgtgaaaagctgattcttgttggggatcccaaacagctacctcctactattcagggttctgatgcagctcatgaaaatggattggaacaaactctttttgatcgactttgcttaatgggtcacaagccaattctattgagaactcaataccgttgtcatcctgcaatcagtgctattgctaatgatctgttttacaaaggagccctcatgaatggtgtaacagaaatagagcggagccctttattggaatggctaccaaccctgtgtttttataatgttaaaggactagaacagatagaaagagataacagctttcataatgtggcagaagctacgtttacactcaagctgattcaatcactgattgcaagtggaatagcaggctctatgattggtgtgataacattatacaaatcccagatgtacaagctttgtcatttactcagtgctgtggactttcaccatcctgatattaaaactgtgcaggtgtccacagtagatgcttttcagggagctgaaaaggagatcattattctgtcctgtgtaaggacaagacaagtaggattcattgattcagaaaaaagaatgaatgttgcattgactagaggaaagaggcatttgttgattgtgggaaatttagcctgtttgaggaaaaatcaactttggggacgagtgatccaacactgcgaaggaagggaagatggattgcaacatgcaaaccagtatgaaccacagctgaaccatctccttaaagattattttgaaaaacaagtggaagaaaaacagaagaaaaagagtgaaaaagagaaatctaaagataaatctcattcataaaaagacatggtgtaaatattttgtatttatgtaaattcagactcattttacatgatatattttttatatttttattactctaaaccctcttattaaaaatatgatatttaaataacatagtaaacacatgtaaaaattttgttcttcaaaaaagtgtacaaaaggtagtataaaatcctactaataaaaataagcttttttctaagaa

SEQ ID NO: 204552 - DNA, 731 bp, Homo sapiens
  Payload ID: 20347
  Gene Name: zinc finger, GRF-type containing 1
  ENST ID: ENST00000502805
  CDS Start-End: 235-420
gcaatttgacaggtgaggtgaagtgtttctcgggatttcctaggaatgacttgagcgatttggggcgaagggacgaaagactctgctccttaagaagagaaccgggaaggatgctgtttggaaccaggattggggtggtcgcagtcacagctactcggactgcttgtagtggtataaatagttgaatatttcctattttctggacccagctggtttataacttcagaagaaataatggaaagccaagaatttattgttctatatactcatcaaaagatgaagaagtcaaaagtgtggcaagatggaattctgaagatcactcacttaggaaacaaaacagagtcttgctctgttgcccaggctggagtgcagtggcacagtcttggctcactacaacctctgcatccaaggttcaagtgattatcctgcctcagcctcctgagtagctgggattacaagcgcccaccaccatgcctggctaatttttgtgtttttagtagagatggggtttcaccatgttggccaggctggtctcaaactcctgacctcaagtgatccacccacctcagcctcctaaagtgctggtattacaggcaattttatatgatgacaaaggagcatgtttggagagtctgtttcttaaatgccttgaggtgaaacctggagatgacttagaaagtgatcgatacttaatcacagttgaagaggttaaagttgctggagccataggt

SEQ ID NO: 204553 - DNA, 6652 bp, Homo sapiens
  Payload ID: 20347
  Gene Name: zinc finger, GRF-type containing 1
  Uniprot ID: Q86YA3
  ENST ID: ENST00000505019
  CDS Start-End: 127-6441
taatgacgtcacgttgtttcgcgggagaaattcgaaagtggattttgtgcaatttgacaggtggtataaatagttgaatatttcctattttctggacccagctggtttataacttcagaagaaataatggaaagccaagaatttattgttctatatactcatcaaaagatgaagaagtcaaaagtgtggcaagatggaattctgaagatcactcacttaggaaacaaagcaattttatatgatgacaaaggagcatgtttggagagtctgtttcttaaatgccttgaggtgaaacctggagatgacttagaaagtgatcgatacttaatcacagttgaagaggttaaagttgctggagccataggtattgttaagcagaatgtcaataaagaagcaccagagttaaattcaaggacatttatatcctctggccgatctcttggatgtcagccctctggcttaaaaaggaagtttactggttttcaaggaccacgtcaggttccaaagaaaatggttattatggaaagtggtgaatcagctgcatcacatgaggctaagaaaactggccctactattttttctccattctgcagcatgcctcctttgtttcctactgttggcaagaaagatgtaaataatatactggcagaccctgagaacattgtgacttacaagaacagggagagaaatgccatggatttttcttcggttttttctccatccttccagattaacccagaagtgctgtgtgaagaaaattatttttgctcacctgtcaattctggaaataagctttcagactctttactgaccaatgagcctgtgaaaagagatagtttggcatctcactattcaggagtttcacaaaacatcagaagcaaagcacagatattagctcttctgaagtccgaatcatctagttcatgtgaggaactaaattctgagatgacagagcattttcctcaaaaacaaccacaaggaagtttaaaaattgctactaaaccaaagtacctaattcaacaggaagagtgtgctgagatgaagagcacagaaaatttatactaccagcatcaatcagaaaataccatgagaaataaaagccggtgggccatgtatttatcctcacagagttcacctatacattcttctactgtagatgggaatgatacagaaaggaaacccaaggcccaggaagatgatgtaaattctaatttgaaagacctttcattacaaaaaattatacagttcgttgaaacgtatgctgaagagaggaaaaagtataatgtagaccagtcagtcggtaataatgatccatcctggaatcaggaagtaaaattagaaattccttcattcaatgaaagcagtagcttacaggttacttgtagcagtgcagaaaatgatggtatattatcagaatctgacattcaagaagataataaaataccttttaatcaaaatgacaaggggtgcattaaaggatcagttctcattaaagaaaatgctcaggaggtaaatacatgtggaacactggaaaaggagtatgaacaatcagagtcatctctgccagaactgaaacatctccaaattgaatctagtaataattctaggatctctgatgacattacagacatgatttctgaaagtaaaatggataatgaaagtcttaatagtattcatgaatctctgagtaatgtaacacaaccatttttggaggtaacttttaatctgaacaattttgagaccagtgacactgaggaggaatcacaggaaagcaacaaaatttcccaggattcagagagttgggtaaaggacattttggttaatgatggcaattcatgttttcaaaagaggtctgagaatacaaactgtgaagagattgagggtgaacatttgccattcttaacatctgttagtgacaaacctacagtgacatttcctgttaaagagactctgccatcacagttttgtgataaaacttatgtgggttttgacatgggaatatgtaaaactgaaaacacaggaaaagaaatagaggagtatagtgacacattaagcaattttgaatctttcaagtggactgatgctgtatacggagataataaagaagatgctaataaacctattcaagaagtcagaattaactatgattttgctttacccccgaataaatctaaaggtataaacatgaatttacatattcctcatattcaaaaccagattgctgaaaacagtaatctattttcagaagatgctcaacctcagccttttattttgggaagtgacttagacaaaaatgatgaacatgttttaccctcaacttctagtagtgacaacagtgtccaactattaaataccaatcagaatcactatgaatgtattgcacttgataaatcaaatacccacatttccaattctttgttttacccactgggaaaaaagcatcttatttccaaagacacagaagcacatatatctgaacctgaagatttgggaaagattagaagtccaccccctgaccatgttgaggttgaaactgccagagaaggcaaacaatactggaatcctagaaattcttcagaactttctggattagtaaataccatttctattttaaagtcgctatgtgaacacagtactgctttagacagcttggaaatattgaaaaagaaaaatactgtctttcagcaaggaactcaacagacgtatgagccagatagccctcctgaagtgaggaaaccatttattacagtagtttcaccaaagtctcctcatctgcacaaggattctcaacagatactaaaagaagatgaagttgaactaagtgaaccacttcagtctgtgcagttctcttcctcgggaagtaaagaagagactgcttttcaagctgttattcctaaacaaatagagagaaaaacctgtgaccctaagcctgttgagtttcaaggacatcaagtaaaaggatcagctactagtggtgtaatggtcagaggacacagctcacagctaggatgcagtcagtttccagatagcactgagtatgaaaactttatgacagagacaccagagttacctagcacgtgtatgcagattgacttcttgcaggtgacatcaccagaagaaaacatctctacattgagccctgtttctaccttttctttgaactcaagagatgaagacttcatggtagaattctctgagacgtccctgaaagcaagaactttacctgatgatcttcattttctcaacttggaggggatgaaaaaatcccgttctctggagaatgagaaccttcaaaggctttcattattaagtagaacccaggttccacttattactttgccacgtactgatgggccacctgacttagactctcattcgtatatgatcaactctaacacatacgagtcttctggctcccccatgctcaatttgtgtgaaaagtcagcagttctttcgtttagcattgagcctgaggaccaaaatgaaacctttttctctgaagaatctagggaagtgaatccaggggatgtttcacttaataatatatctactcagagcaagtggctgaaatatcaaaacacatcccaatgcaacgtggctactccaaacagagttgataagagaataactgatggcttctttgctgaggctgtttctgggatgcattttagagacacaagtgaaagacagagtgatgctgtcaatgaaagctctttagactctgtgcatttgcaaatgataaaaggcatgctctatcaacagcggcaggattttagcagtcaagattcggtttccagaaagaaagtactttctctgaatttaaagcagacttctaagacagaggaaattaaaaatgtattaggagggtctacctgctacaactacagtgtaaaggatttacaggagataagtggctctgagctgtgctttccaagtgggcagaaaataaaatctgcttatcttccccaaaggcaaattcacataccagctgtttttcagtctcctgctcattataagcagactttcacatcttgcctcatagaacatctaaatatattgctgtttgggttagcacaaaacctgcagaaagctctttcaaaagttgacatatcattttatacatcattgaagggagagaaactgaaaaacgcagaaaataatgtaccatcctgccatcatagtcaacctgcaaaacttgtcatggttaaaaaggaaggtccaaataagggtcgtctcttttatacatgtgatggacccaaagctgatcgatgtaaattctttaaatggcttgaggacgtgactccaggatattcaacacaggaaggagctcgacctggcatggttttaagtgatattaagagtattggcttatatttaagaagtcaaaagataccactttatgaggaatgccagcttttggtgagaaaaggatttgattttcagagaaaacagtatggcaaactaaagaagtttactactgtaaatcctgagttttataatgaaccaaaaaccaaactttatcttaagctaagtcggaaggaaagatcttcagcttatagcaaaaatgatctttgggtggtttcaaaaaccctagactttgagctggatacttttatcgcatgtagtgctttctttggaccatcatctatcaatgagatagaaatactgcctttgaaaggctatttcccttctaattggcccactaacatggttgtccatgcgttattggtttgtaatgctagcacagaactgactactttgaaaaacattcaggactactttaatccagctactctacctctaacacagtacctgttaacaacgtcttcgccaactatagttagtaacaaaagagtcagtaagagaaaatttatcccaccagccttcacaaatgtcagtacaaaatttgaactactcagcctaggagcaacattgaagttagctagtgagttgattcaggtacacaagttaaacaaggatcaagctacagctctaattcaaatagctcaaatgatggcatcacatgaaagcattgaagaagtgaaggaactgcaaactcataccttccctatcacaatcatacatggtgtgtttggagcaggaaagagttacttgctggcagtggtgattttgttctttgtacagctgtttgaaaagagtgaagctcccaccattggaaatgcaaggccgtggaaacttctgatttcttcttctactaatgtggctgttgacagagtacttcttgggcttctcagtcttggatttgaaaactttatcagagttgggagtgttaggaagattgccaaaccaattttaccttatagcttgcatgctggctcagaaaatgaaagtgaacagttaaaagaactacatgcactaatgaaagaagacctgactcctacggaaagagtctatgtgagaaaaagcattgagcagcataaactggggaccaatagaaccctgctgaagcaggttcgagtagttggagttacctgtgcagcctgcccattcccatgcatgaatgatcttaaatttcctgtagttgtgctggatgagtgtagtcagataactgaaccggcctctctccttcccattgcaaggtttgagtgtgaaaagctgattcttgttggggatcccaaacagctacctcctactattcagggttctgatgcagctcatgaaaatggattggaacaaactctttttgatcgactttgcttaatgggtcacaagccaattctattgagaactcaataccgttgtcatcctgcaatcagtgctattgctaatgatctgttttacaaaggagccctcatgaatggtgtaacagaaatagagcggagccctttattggaatggctaccaaccctgtgtttttataatgttaaaggactagaacagatagaaagagataacagctttcataatgtggcagaagctacgtttacactcaagctgattcaatcactgattgcaagtggaatagcaggctctatgattggtgtgataacattatacaaatcccagatgtacaagctttgtcatttactcagtgctgtggactttcaccatcctgatattaaaactgtgcaggtgtccacagtagatgcttttcagggagctgaaaaggagatcattattctgtcctgtgtaaggacaagacaagtaggattcattgattcagaaaaaagaatgaatgttgcattgactagaggaaagaggcatttgttgattgtgggaaatttagcctgtttgaggaaaaatcaactttggggacgagtgatccaacactgcgaaggaagggaagatggattgcaacatgcaaaccagtatgaaccacagctgaaccatctccttaaagattattttgaaaaacaagtggaagaaaaacagaagaaaaagagtgaaaaagagaaatctaaagataaatctcattcataaaaagacatggtgtaaatattttgtatttatgtaaattcagactcattttacatgatatattttttatatttttattactctaaaccctcttattaaaaatatgatatttaaataacatagtaaacacatgtaaaaattttgttcttcaaaaaagtgtacaaaaggtagtataaaatcctactaataaaaataagcttttttctaagaagaa

SEQ ID NO: 204554 - DNA, 3416 bp, Homo sapiens
  Payload ID: 20347
  Gene Name: zinc finger, GRF-type containing 1
  ENST ID: ENST00000514770
  CDS Start-End: 206-322
gatttgaaagcggcggtttttggcttaggcggaggtgggcgggccaagttttgggtcctcatctggtgaggtcccgcgttaatgacgtcacgttgtttcgcgggagaaattcgaaagtggattttgtgcaatttgacaggtggtataaatagttgaatatttcctattttctggacccagctggtttataacttcagaagaaataatggaaagccaagaatttattgttctatatactcatcaaaagatgaagaagtcaaaagtgtggcaagatggaattctgaagatcactcacttaggaaacaaaatccagtgtctttaaaatcttgtagatatttaaaagccatctgattggattctgcatatcctttgtgttgtcttctggttccaaattattatggtcatgctagtgctattatccaactttatcttcaactatagcatacatttgttgagtgcccattatatatctcacacaagtaggttataggaaaacaagatagattcaagttagtccctgaaagtttctatgttccaggcaattttatatgatgacaaaggagcatgtttggagagtctgtttcttaaatgccttgaggtgaaacctggagatgacttagaaagtgatcgatacttaatcacagttgaagaggttaaagttgctggagccataggtattgttaagcagaatgtcaataaagaagcaccagagttaaattcaaggacatttatatcctctggccgatctcttggatgtcagccctctggcttaaaaaggaagtttactggttttcaaggaccacgtcaggttccaaagaaaatggttattatggaaagtggtgaatcagctgcatcacatgaggctaagaaaactggccctactattttttctccattctgcagcatgcctcctttgtttcctactgttggcaagaaagatgtaaataatatactggcagaccctgagaacattgtgacttacaagaacagggagagaaatgccatggatttttcttcggttttttctccatccttccagattaacccagaagtgctgtgtgaagaaaattatttttgctcacctgtcaattctggaaataagctttcagactctttactgaccaatgagcctgtgaaaagagatagtttggcatctcactattcaggagtttcacaaaacatcagaagcaaagcacagatattagctcttctgaagtccgaatcatctagttcatgtgaggaactaaattctgagatgacagagcattttcctcaaaaacaaccacaaggaagtttaaaaattgctactaaaccaaagtacctaattcaacaggaagagtgtgctgagatgaagagcacagaaaatttatactaccagcatcaatcagaaaataccatgagaaataaaagccggtgggccatgtatttatcctcacagagttcacctatacattcttctactgtagatgggaatgatacagaaaggaaacccaaggcccaggaagatgatgtaaattctaatttgaaagacctttcattacaaaaaattatacagttcgttgaaacgtatgctgaagagaggaaaaagtataatgtagaccagtcagtcggtaataatgatccatcctggaatcaggaagtaaaattagaaattccttcattcaatgaaagcagtagcttacaggttacttgtagcagtgcagaaaatgatggtatattatcagaatctgacattcaagaagataataaaataccttttaatcaaaatgacaaggggtgcattaaaggatcagttctcattaaagaaaatgctcaggaggtaaatacatgtggaacactggaaaaggagtatgaacaatcagagtcatctctgccagaactgaaacatctccaaattgaatctagtaataattctaggatctctgatgacattacagacatgatttctgaaagtaaaatggataatgaaagtcttaatagtattcatgaatctctgagtaatgtaacacaaccatttttggaggtaacttttaatctgaacaattttgagaccagtgacactgaggaggaatcacaggaaagcaacaaaatttcccaggattcagagagttgggtaaaggacattttggttaatgatggcaattcatgttttcaaaagaggtctgagaatacaaactgtgaagagattgagggtgaacatttgccattcttaacatctgttagtgacaaacctacagtgacatttcctgttaaagagactctgccatcacagttttgtgataaaacttatgtgggttttgacatgggaatatgtaaaactgaaaacacaggaaaagaaatagaggagtatagtgacacattaagcaattttgaatctttcaagtggactgatgctgtatacggagataataaagaagatgctaataaacctattcaagaagtcagaattaactatgattttgctttacccccgaataaatctaaaggtataaacatgaatttacatattcctcatattcaaaaccagattgctgaaaacagtaatctattttcagaagatgctcaacctcagccttttattttgggaagtgacttagacaaaaatgatgaacatgttttaccctcaacttctagtagtgacaacagtgtccaactattaaataccaatcagaatcactatgaatgtattgcacttgataaatcaaatacccacatttccaattctttgttttacccactgggaaaaaagcatcttatttccaaagacacagaagcacatatatctgaacctgaagatttgggaaagattagaagtccaccccctgaccatgttgaggttgaaactgccagagaaggcaaacaatactggaatcctagaaattcttcagaactttctggattagtaaataccatttctattttaaagtcgctatgtgaacacagtactgctttagacagcttggaaatattgaaaaagaaaaatactgtctttcagcaaggaactcaacagacgtatgagccagatagccctcctgaagtgaggaaaccatttattacagtagtttcaccaaagtctcctcatctgcacaaggattctcaacagaaaacagtgaagaaaaaaataaaacctaccctgcctctcagaatatttattaatgtttccagatttttttgtgtccagttaaaaaaaatggttagattgatgtatataaatagttttatatcctttccccttaatatcgttgtattatcttacattattaataattcttcttaaacatactttttaaaagttatttaccatccatcctatggctatcttgtgctttggacaaatagttctctgttttggtcatttaaataatttccagcattttgctattataagtaacactttaataaatgtttttacacat

SEQ ID NO: 204555 - DNA, 794 bp, Homo sapiens
  Payload ID: 20347
  Gene Name: zinc finger, GRF-type containing 1
  ENST ID: ENST00000503172
  CDS Start-End: 271-794
gttgtttcgcgggagaaattcgaaagtggattttgtgcaatttgacaggtgaggtgaagtgtttctcgggatttcctaggaatgacttgagcgatttggggcgaagggacgaaagactctgctccttaagaagagaaccgggaaggatgctgtttggaaccaggattggggtggtcgcagtcacagctactcggactgcttgtagtggtataaatagttgaatatttcctattttctggacccagctggtttataacttcagaagaaataatggaaagccaagaatttattgttctatatactcatcaaaagatgaagaagtcaaaagtgtggcaagatggaattctgaagatcactcacttaggaaacaaagcaattttatatgatgacaaaggagcatgtttggagagtctgtttcttaaatgccttgaggtgaaacctggagatgacttagaaagtgatcgatacttaatcacagttgaagaggttaaagttgctggagccataggtattgttaagcagaatgtcaataaagaagcaccagagttaaattcaaggacatttatatcctctggccgatctcttggatgtcagccctctggcttaaaaaggaagtttactggttttcaaggaccacgtcaggttccaaagaaaatggttattatggaaagtggtgaatcagctgcatcacatgaggctaagaaaactggccctactattttttctccattctgcagcatgcctcctttgtttcctactgttggcaagaaagatgtaaataatatactggcaga

SEQ ID NO: 204556 - DNA, 4589 bp, Homo sapiens
  Payload ID: 20347
  Gene Name: zinc finger, GRF-type containing 1
  ENST ID: ENST00000473015
  CDS Start-End: 120-2927
gtcacgttgtttcgcgggagaaattcgaaagtggattttgtgcaatttgacaggtggtataaatagttgaatatttcctattttctggacccagctggtttataacttcagaagaaataatggaaagccaagaatttattgttctatatactcatcaaaagatgaagaagtcaaaagtgtggcaagatggaattctgaagatcactcacttaggaaacaaagcaattttatatgatgacaaaggagcatgtttggagagtctgtttcttaaatgccttgaggtgaaacctggagatgacttagaaagtgatcgatacttaatcacagttgaagaggttaaagttgctggagccataggtattgttaagcagaatgtcaataaagaagcaccagagttaaattcaaggacatttatatcctctggccgatctcttggatgtcagccctctggcttaaaaaggaagtttactggttttcaaggaccacgtcaggttccaaagaaaatggttattatggaaagtggtgaatcagctgcatcacatgaggctaagaaaactggccctactattttttctccattctgcagcatgcctcctttgtttcctactgttggcaagaaagatgtaaataatatactggcagaccctgagaacattgtgacttacaagaacagggagagaaatgccatggatttttcttcggttttttctccatccttccagattaacccagaagtgctgtgtgaagaaaattatttttgctcacctgtcaattctggaaataagctttcagactctttactgaccaatgagcctgtgaaaagagatagtttggcatctcactattcaggagtttcacaaaacatcagaagcaaagcacagatattagctcttctgaagtccgaatcatctagttcatgtgaggaactaaattctgagatgacagagcattttcctcaaaaacaaccacaaggaagtttaaaaattgctactaaaccaaagtacctaattcaacaggaagagtgtgctgagatgaagagcacagaaaatttatactaccagcatcaatcagaaaataccatgagaaataaaagccggtgggccatgtatttatcctcacagagttcacctatacattcttctactgtagatgggaatgatacagaaaggaaacccaaggcccaggaagatgatgtaaattctaatttgaaagacctttcattacaaaaaattatacagttcgttgaaacgtatgctgaagagaggaaaaagtataatgtagaccagtcagtcggtaataatgatccatcctggaatcaggaagtaaaattagaaattccttcattcaatgaaagcagtagcttacaggttacttgtagcagtgcagaaaatgatggtatattatcagaatctgacattcaagaagataataaaataccttttaatcaaaatgacaaggggtgcattaaaggatcagttctcattaaagaaaatgctcaggaggtaaatacatgtggaacactggaaaaggagtatgaacaatcagagtcatctctgccagaactgaaacatctccaaattgaatctagtaataattctaggatctctgatgacattacagacatgatttctgaaagtaaaatggataatgaaagtcttaatagtattcatgaatctctgagtaatgtaacacaaccatttttggaggtaacttttaatctgaacaattttgagaccagtgacactgaggaggaatcacaggaaagcaacaaaatttcccaggattcagagagttgggtaaaggacattttggttaatgatggcaattcatgttttcaaaagaggtctgagaatacaaactgtgaagagattgagggtgaacatttgccattcttaacatctgttagtgacaaacctacagtgacatttcctgttaaagagactctgccatcacagttttgtgataaaacttatgtgggttttgacatgggaatatgtaaaactgaaaacacaggaaaagaaatagaggagtatagtgacacattaagcaattttgaatctttcaagtggactgatgctgtatacggagataataaagaagatgctaataaacctattcaagaagtcagaattaactatgattttgctttacccccgaataaatctaaaggtataaacatgaatttacatattcctcatattcaaaaccagattgctgaaaacagtaatctattttcagaagatgctcaacctcagccttttattttgggaagtgacttagacaaaaatgatgaacatgttttaccctcaacttctagtagtgacaacagtgtccaactattaaataccaatcagaatcactatgaatgtattgcacttgataaatcaaatacccacatttccaattctttgttttacccactgggaaaaaagcatcttatttccaaagacacagaagcacatatatctgaacctgaagatttgggaaagattagaagtccaccccctgaccatgttgaggttgaaactgccagagaaggcaaacaatactggaatcctagaaattcttcagaactttctggattagtaaataccatttctattttaaagtcgctatgtgaacacagtactgctttagacagcttggaaatattgaaaaagaaaaatactgtctttcagcaaggaactcaacagacgtatgagccagatagccctcctgaagtgaggaaaccatttattacagtagtttcaccaaagtctcctcatctgcacaaggattctcaacagatactaaaagaagatgaagttgaactaagtgaaccacttcagtctgtgcagttctcttcctcgggaagtaaagaagagactgcttttcaagctgttattcctaaacaaatagagagaaaaacctgtgaccctaagggatgaaaaaatcccgttctctggagaatgagaaccttcaaaggctttcattattaagtagaacccaggttccacttattactttgccacgtactgatgggccacctgacttagactctcattcgtatatgatcaactctaacacatacgagtcttctggctcccccatgctcaatttgtgtgaaaagtcagcagttctttcgtttagcattgagcctgaggaccaaaatgaaacctttttctctgaagaatctagggaagtgaatccaggggatgtttcacttaataatatatctactcagagcaagtggctgaaatatcaaaacacatcccaatgcaacgtggctactccaaacagagttgataagagaataactgatggcttctttgctgaggctgtttctgggatgcattttagagacacaagtgaaagacagagtgatgctgtcaatgaaagctctttagactctgtgcatttgcaaatgataaaaggcatgctctatcaacagcggcaggattttagcagtcaagattcggtttccagaaagaaagtactttctctgaatttaaagcagacttctaagacagaggaaattaaaaatgtattaggagggtctacctgctacaactacagtgtaaaggatttacaggagataagtggctctgagctgtgctttccaagtgggcagaaaataaaatctgcttatcttccccaaaggcaaattcacataccagctgtttttcagtctcctgctcattataagcagactttcacatcttgcctcatagaacatctaaatatattgctgtttgggttagcacaaaacctgcagaaagctctttcaaaagttgacatatcattttatacatcattgaagggagagaaactgaaaaacgcagaaaataatgtaccatcctgccatcatagtcaacctgcaaaacttgtcatggttaaaaaggaaggtccaaataagggtcgtctcttttatacatgtgatggacccaaagctgatcgatgtaaattctttaaatggcttgaggacgtgactccaggatattcaacacaggaaggagctcgacctggcatggttttaagtgatattaagagtattggcttatatttaagaagtcaaaagataccactttatgaggaatgccagcttttggtgagaaaaggatttgattttcagagaaaacagtatggcaaactaaagaagtttactactgtaaatcctgagttttataatgaaccaaaaaccaaactttatcttaagctaagtcggaaggaaagatcttcagcttatagcaaaaatgatctttgggtggtttcaaaaaccctagactttgagctggatacttttatcgcatgtagtgctttctttggaccatcatctatcaatgagatagaaatactgcctttgaaaggctatttcccttctaattggcccactaacatggttgtccatgcgttattggtttgtaatgctagcacagaactgactactttgaaaaacattcaggactactttaatccagctactctacctctaacacagtacctgttaacaacgtaagtcattttttacctttgagtcattggtattaaaaaatggtaatcagaagtaaatatgaaaattcaataaaagtacagtatataaatgttgccaa

SEQ ID NO: 204557 - DNA, 2176 bp, Homo sapiens
  Payload ID: 20347
  Gene Name: zinc finger, GRF-type containing 1
  Uniprot ID: Q86YA3
  ENST ID: ENST00000612287
  CDS Start-End: 1254-1973
ggttttaagtgatattaagagtattggcttatatttaagaagtcaaaagataccactttatgaggaatgccagcttttggtgagaaaaggatttgattttcagagaaaacagtatggcaaactaaagaagtttactactgtaaatcctgagttttataatgaaccaaaaaccaaactttatcttaagctaagtcggaaggaaagatcttcagcttatagcaaaaatgatctttgggtggtttcaaaaaccctagactttgagctggatacttttatcgcatgtagtgctttctttggaccatcatctatcaatgagatagaaatactgcctttgaaaggctatttcccttctaattggcccactaacatggttgtccatgcgttattggtttgtaatgctagcacagaactgactactttgaaaaacattcaggactactttaatccagctactctacctctaacacagtacctgttaacaacgtcttcgccaactatagttagtaacaaaagagtcagtaagagaaaatttatcccaccagccttcacaaatgtcagtacaaaatttgaactactcagcctaggagcaacattgaagttagctagtgagttgattcaggtacacaagttaaacaaggatcaagctacagctctaattcaaatagctcaaatgatggcatcacatgaaagcattgaagaagtgaaggaactgcaaactcataccttccctatcacaatcatacatggtgtgtttggagcaggaaagagttacttgctggcagtggtgattttgttctttgtacagctgtttgaaaagagtgaagctcccaccattggaaatgcaaggccgtggaaacttctgatttcttcttctactaatgtggctgttgacagagtacttcttgggcttctcagtcttggatttgaaaactttatcagagttgggagtgttaggaagattgccaaaccaattttaccttatagcttgcatgctggctcagaaaatgaaagtgaacagttaaaagaactacatgcactaatgaaagaagacctgactcctacggaaagagtctatgtgagaaaaagcattgagcagcataaactggggaccaatagaaccctgctgaagcaggtttgagtgtgaaaagctgattcttgttggggatcccaaacagctacctcctactattcagggttctgatgcagctcatgaaaatggattggaacaaactctttttgatcgactttgcttaatgggtcacaagccaattctattgagaactcaataccgttgtcatcctgcaatcagtgctattgctaatgatctgttttacaaaggagccctcatgaatggtgtaacagaaatagagcggagccctttattggaatggctaccaaccctgtgtttttataatgttaaaggactagaacagatagaaagagataacagctttcataatgtggcagaagctacgtttacactcaagctgattcaatcactgattgcaagtggaatagcaggctctatgattggtgtgataacattatacaaatcccagatgtacaagctttgtcatttactcagtgctgtggactttcaccatcctgatattaaaactgtgcaggtgtccacagtagatgcttttcagggagctgaaaaggagatcattattctgtcctgtgtaaggacaagacaagtaggattcattgattcagaaaaaagaatgaatgttgcattgactagaggaaagaggcatttgttgattgtgggaaatttagcctgtttgaggaaaaatcaactttggggacgagtgatccaacactgcgaaggaagggaagatggattgcaacatgcaaaccagtatgaaccacagctgaaccatctccttaaagattattttgaaaaacaagtggaagaaaaacagaagaaaaagagtgaaaaagagaaatctaaagataaatctcattcataaaaagacatggtgtaaatattttgtatttatgtaaattcagactcattttacatgatatattttttatatttttattactctaaaccctcttattaaaaatatgatatttaaataacatagtaaacacatgtaaaaattttgttcttcaaaaaagtgtacaaaaggtagtataaaatcctactaataaaaataagcttttttct

SEQ ID NO: 204558 - DNA, 1225 bp, Homo sapiens
  Payload ID: 20348
  Gene Name: zinc finger, HIT-type containing 1
  Uniprot ID: O43257
  ENST ID: ENST00000305105
  CDS Start-End: 529-993
gagagtgcgggcggaagacggggagagcgagaggctggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcggttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaa

SEQ ID NO: 204559 - DNA, 1306 bp, Homo sapiens
  Payload ID: 20349
  Gene Name: zinc finger, HIT-type containing 2
  Uniprot ID: Q9UHR6
  ENST ID: ENST00000310597
  CDS Start-End: 56-1267
aagtttcgaactaccaccggcgtgcgttcgcaggtagatcgcggtgccagttgccatggagccggccgggccctgtggcttctgcccggcgggggaggtccagccagcgcgttacacctgccctcgctgtaatgcgccctactgctcgctgcgctgctaccggacgcatggcacctgcgcagaaaacttctaccgtgaccaggtgctgggagagctccgcggttgcagcgctcctcccagccgcctagcaagcgccctacgccggctgcgtcagcaacgcgagaccgaggacgagcctggggaagcaggcctcagctccggcccggcgcccggcggcctatcgggactctgggagcggctggcgccgggcgaaaaagctgccttcgagcggctgctgagccgcggtgaggccgggcggctgctgcctccatggcggccgtggtggtggaaccgcggagccggaccgcagcttctggaggagctggataatgccccgggtagtgacgccgcggagctggagctcgcccctgcgaggaccccgccggattctgtgaaagatgcctccgccgcggagcccgcggccgccgagcgggttcttggagatgtcccgggggcctgcacgcccgtcgtacccacccgcatccccgcgatagtcagcctgagccgcggcccagtctcgccgctcgtgcgcttccagctgcccaatgtgctgttcgcctacgcgcatactctcgccctgtatcacggcggtgacgacgcgctgctctctgacttctgtgccacactgctcggcgtttccggagccctgggtgcccagcaagtcttcgcctctgcggaagaagccctgcaggcggcagcccacgtgctggaagcaggcgagcacccgccggggcccctgggcacacgaggggctatgcacgaggtcgcccgcatcctgctgggcgagggcccgaccaaccagaaaggctacacgctggcagcactgggggacctggcacagaccctgggccgtgcccggaaacaggccgtggctagagaagagcgagatcatctttaccgggcccggaaaaagtgccagttcctcctggcctggaccaacgaaaatgaggcggccctcacacccctggccctagactgcgccagggctcaccaagcccatgctgtggtagccgaggaggtggccgccctcactggggagctggagcggctttggggaggccccgtgccacctgccccaagaactctcattgaggagctccctagctgaacgggttaccctggtcattaataaagctgtgactggtca

SEQ ID NO: 204560 - DNA, 579 bp, Homo sapiens
  Payload ID: 20349
  Gene Name: zinc finger, HIT-type containing 2
  ENST ID: ENST00000528598
  CDS Start-End: 21-579
agatcgcggtgccagttgccatggagccggccgggccctgtggcttctgcccggcgggggaggtccagccagcgcgttacacctgccctcgctgtaatgcgccctactgctcgctgcgctgctaccggacgcatggcacctgcgcagaaaacttctaccgtgaccagctgcccaatgtgctgttcgcctacgcgcatactctcgccctgtatcacggcggtgacgacgcgctgctctctgacttctgtgccacactgctcggcgtttccggagccctgggtgcccagcaagtcttcgcctctgcggaagaagccctgcaggcggcagcccacgtgctggaagcaggcgagcacccgccggggcccctgggcacacgaggggctatgcacgaggtcgcccgcatcctgctgggcgagggcccgaccaaccagaaaggctacacgctggcagcactgggggacctggcacagaccctgggccgtgcccggaaacaggccgtggctagagaagagcgagatcatctttaccgggcccggaaaaagtgccagttcctcctggcctggaccaacgaaaatgagg

SEQ ID NO: 204561 - DNA, 567 bp, Homo sapiens
  Payload ID: 20350
  Gene Name: zinc finger, HIT-type containing 3
  ENST ID: ENST00000622312
  CDS Start-End: 7-129
aaaaccatggcgtcgctcaaatgtagcaccgtcgtctgcgtgatctgcttggagaagcccaaataccgctgtccagcctgccgcgtgccctatgcaaccctgaaactcgtcctgttgagaaaaaaataagatcagctcttcctaccaaaaccgtaaagcctgtggaaaacaaagatgatgatgactctatagctgattttctcaatagtgatgaggaagaagacagagtttctttgcagaatttaaagaatttagatggactctcgtcctgtcacccaggctggagtgcagcggcgcaatctcggctcactgcaacctctccctcccagattcaagcaattctcatgcctcagcctcccgagcagctgggactacaggcgcctgccactacgcccaaccaatttttgtatttttagtagagatggggtttcgccatgttggccaggctggtcttgaactcctgacctcaggtgatacacccgcctcgacttcccaaagtactgggattataggcgtgagccaccgctccaggccctaagctaaactttcatcacctcctgctcctga

SEQ ID NO: 204562 - DNA, 834 bp, Homo sapiens
  Payload ID: 20350
  Gene Name: zinc finger, HIT-type containing 3
  Uniprot ID: Q15649
  ENST ID: ENST00000619649
  CDS Start-End: 6-452
aaaccatggcgtcgctcaaatgtagcaccgtcgtctgcgtgatctgcttggagaagcccaaataccgctgtccagcctgccgcgtgccctactgctcggtagtctgcttccggaagcacaaagaacagtgcaaccctgaaactcgtcctgttgagaaaaaaataagatcagctcttcctaccaaaaccgtaaagcctgtggaaaacaaagatgatgatgactctatagctgattttctcaatagtgatgaggaagaagacagagtttctttgcagaatttaaagaatttagatggactctcgtcctgtcacccaggctggagtgcagcggcgcaatctcggctcactgcaacctctccctcccagattcaagcaattctcatgcctcagcctcccgagcagctgggactacaggcgcctgccactacgcccaaccaatttttgtatttttagtagagatggggtttcgccatgttggccaggctggtcttgaactcctgacctcaggtgatacacccgcctcgacttcccaaagtactgggattataggcgtgagccaccgctccaggccctaagctaaactttcatcacctcctgctcctgactcatctaaagccttggttctcacagtgtggttcatggagcatcagaatcagctgggagcttgctagaaacgcagcattgcatttggaaatgggactagaagatttagagatgctgaaataattagaagcagtttttaaaaagataaagggctctggaagattcccagttataacaaaataaataatccaaacctgcagctgattgggacatgcagccctctggtttaccc

SEQ ID NO: 204563 - DNA, 834 bp, Homo sapiens; identical to SEQ ID NO: 204562
  Payload ID: 20350
  Gene Name: zinc finger, HIT-type containing 3
  Uniprot ID: Q15649
  ENST ID: ENST00000620324
  CDS Start-End: 6-452

SEQ ID NO: 204564 - DNA, 926 bp, Homo sapiens
  Payload ID: 20350
  Gene Name: zinc finger, HIT-type containing 3
  ENST ID: ENST00000619730
  CDS Start-End: 379-507
gggcgtgcacgcgggcgcggctgcgtgagaggcgcgcggcggcgcagtgaacagtctccttccacaaaaccatggcgtcgctcaaatgtagcaccgtcgtctgcgtgatctgcttggagaagcccaaataccgctgtccagcctgccgcgtgccctaaacagtgcaaccctgaaactcgtcctgttgagaaaaaaataagatcagctcttcctaccaaaaccgtaaagcctgtggaaaacaaagatgatgatgactctatagctgattttctcaatagtgatgaggaagaagacagagtttctttgcagaatttaaagaatttaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgctgtttaggaattgtggagccatcccagaatgaggagtcttaagatggattattgtgctgcttgctcaagcgtgtgcttgactcctggaacctgcctgctccctctcccagaccagctagtttggggctggggagctcaggcaaaagaggtttccaggatgcagattaggtcatgcaggcctttaccggcattgatgtggctcatgtttcaggcagacttggggtccttaaggtggcaagtcctttatggagagaaaacttgacattcagatgattgtttttaaatgttttacttttggtacagttgatagacatcataaacgatatcaagcttacacttcatatggagttaaacttggtcagtgttaataaaatcaaaacgtgattctactgtacattgcattattcataatttaattgtttgaaattacattaaataaatcaactaattaaatactaaag

SEQ ID NO: 204565 - DNA, 951 bp, Homo sapiens
  Payload ID: 20350
  Gene Name: zinc finger, HIT-type containing 3
  Uniprot ID: Q15649
  ENST ID: ENST00000620508
  CDS Start-End: 66-533
gcacgcgggcgcggctgcgtgagaggcgcgcggcggcgcagtgaacagtctccttccacaaaaccatggcgtcgctcaaatgtagcaccgtcgtctgcgtgatctgcttggagaagcccaaataccgctgtccagcctgccgcgtgccctactgctcggtagtctgcttccggaagcacaaagaacagtgcaaccctgaaactcgtcctgttgagaaaaaaataagatcagctcttcctaccaaaaccgtaaagcctgtggaaaacaaagatgatgatgactctatagctgattttctcaatagtgatgaggaagaagacagagtttctttgcagaatttaaagaatttaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgctgtttaggaattgtggagccatcccagaatgaggagtcttaagatggattattgtgctgcttgctcaagcgtgtgcttgactcctggaacctgcctgctccctctcccagaccagctagtttggggctggggagctcaggcaaaagaggtttccaggatgcagattaggtcatgcaggcctttaccggcattgatgtggctcatgtttcaggcagacttggggtccttaaggtggcaagtcctttatggagagaaaacttgacattcagatgattgtttttaaatgttttacttttggtacagttgatagacatcataaacgatatcaagcttacacttcatatggagttaaacttggtcagtgttaataaaatcaaaacgtgattctactgtacattgcattattcataatttaattgtttgaaattacattaaataaatcaactaattaaatactaaa

SEQ ID NO: 204566 - DNA, 616 bp, Homo sapiens
  Payload ID: 20350
  Gene Name: zinc finger, HIT-type containing 3
  ENST ID: ENST00000616269
  CDS Start-End: 1-272
tctgcgtgatctgcttggagaagcccaaataccgctgtccagcctgccgcgtgccctactgctcggtagtctgcttccggaagcacaaaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgctgtttaggaattgtggagccatcccagaatgaggagtcttaagatggattattgtgctgcttgctcaagcgtgtgcttgactcctggaacctgcctgctccctctcccagaccagctagtttggggctggggagctcaggcaaaagaggtttccaggatgcagattaggtcatgcaggcctttaccggcattgatgtggctcatgtttcaggcagacttggggtccttaaggtggcaagtcctttatggagagaaaacttgacattcagatgattgtttttaaatgttttacttttggtacagttgatagacatcataaacgatatcaagcttacacttcatatggagttaaacttggtcagtgttaataaaatcaaaacgtgatt

SEQ ID NO: 204567 - DNA, 494 bp, Homo sapiens
  Payload ID: 20350
  Gene Name: zinc finger, HIT-type containing 3
  ENST ID: ENST00000612494
  CDS Start-End: 458-494
tgcagccttgacacactgggcttaagggatcctcctgcctcagcctcccaagtagctgagaccacatgtgtgtaccaccatgcctggatgattttttttattttctgtagagacatagtcttgctaggttgcccaggctggtctcaaactcctgggctcaagtgatcctcccaccttggcctccgaatgttaggattacaggcgtgagccagcacagctggccttctgttgactctaacagtgcaaccctgaaactcgtcctgttgagaaaaaaataagatcagctcttcctaccaaaaccgtaaagcctgtggaaaacaaagatgatgatgactctatagctgattttctcaatagtgatgaggaagaagacagagtttctttgcagaatttaaagaatttaggggaatctgcaacattaagaagcttattgctcaatccacacctcaggcagttgatggtcaacctcgatcagggagaagacaaagcaaagc

SEQ ID NO: 204568 - DNA, 616 bp, Homo sapiens; identical to SEQ ID NO: 204566
  Payload ID: 20350
  Gene Name: zinc finger, HIT-type containing 3
  ENST ID: ENST00000613198
  CDS Start-End: 1-272

SEQ ID NO: 204569 - DNA, 881 bp, Homo sapiens
  Payload ID: 20350
  Gene Name: zinc finger, HIT-type containing 3
  ENST ID: ENST00000620863
  CDS Start-End: 1-129
atggcgtcgctcaaatgtagcaccgtcgtctgcgtgatctgcttggagaagcccaaataccgctgtccagcctgccgcgtgccctactgctcggtagtctgcttccggaagcacaaagtgcaaccctgaaactcgtcctgttgagaaaaaaataagatcagctcttcctaccaaaaccgtaaagcctgtggaaaacaaagatgatgatgactctatagctgattttctcaatagtgatgaggaagaagacagagtttctttgcagaatttaaagaatttaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgctgtttaggaattgtggagccatcccagaatgaggagtcttaagatggattattgtgctgcttgctcaagcgtgtgcttgactcctggaacctgcctgctccctctcccagaccagctagtttggggctggggagctcaggcaaaagaggtttccaggatgcagattaggtcatgcaggcctttaccggcattgatgtggctcatgtttcaggcagacttggggtccttaaggtggcaagtcctttatggagagaaaacttgacattcagatgattgtttttaaatgttttacttttggtacagttgatagacatcataaacgatatcaagcttacacttcatatggagttaaacttggtcagtgttaataaaatcaaaacgtgattctactgtacattgcattattcataatttaattgtttgaaattacattaaataaatcaactaattaaatactaaa

SEQ ID NO: 204570 - DNA, 505 bp, Homo sapiens
  Payload ID: 20350
  Gene Name: zinc finger, HIT-type containing 3
  ENST ID: ENST00000622013
  CDS Start-End: 418-505
cttgacacactgggcttaagggatcctcctgcctcagcctcccaagtagctgagaccacatgtgtgtaccaccatgcctggatgattttttttattttctgtagagacatagtcttgctaggttgcccaggctggtctcaaactcctgggctcaagtgatcctcccaccttggcctccgaatgttaggattacaggcgtgagccagcacagctggccttctgttgactctaacagtgcaaccctgaaactcgtcctgttgagaaaaaaataagatcagctcttcctaccaaaaccgtaaagcctgtggaaaacaaagtgatgaggaagaagacagagtttctttgcagaatttaaagaatttaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgct

SEQ ID NO: 204571 - DNA, 951 bp, Homo sapiens; identical to SEQ ID NO: 204565
  Payload ID: 20350
  Gene Name: zinc finger, HIT-type containing 3
  Uniprot ID: Q15649
  ENST ID: ENST00000617429
  CDS Start-End: 66-533

SEQ ID NO: 204572 - DNA, 505 bp, Homo sapiens; identical to SEQ ID NO: 204570
  Payload ID: 20350
  Gene Name: zinc finger, HIT-type containing 3
  ENST ID: ENST00000634200
  CDS Start-End: 418-505

SEQ ID NO: 204573 - DNA, 926 bp, Homo sapiens; identical to SEQ ID NO: 204564
  Payload ID: 20350
  Gene Name: zinc finger, HIT-type containing 3
  ENST ID: ENST00000631862
  CDS Start-End: 379-507

SEQ ID NO: 204574 - DNA, 567 bp, Homo sapiens; identical to SEQ ID NO: 204561
  Payload ID: 20350
  Gene Name: zinc finger, HIT-type containing 3
  ENST ID: ENST00000632245
  CDS Start-End: 7-129

SEQ ID NO: 204575 - DNA, 494 bp, Homo sapiens; identical to SEQ ID NO: 204567
  Payload ID: 20350
  Gene Name: zinc finger, HIT-type containing 3
  ENST ID: ENST00000633117
  CDS Start-End: 458-494

SEQ ID NO: 204576 - DNA, 881 bp, Homo sapiens; identical to SEQ ID NO: 204569
  Payload ID: 20350
  Gene Name: zinc finger, HIT-type containing 3
  ENST ID: ENST00000633937
  CDS Start-End: 1-129

SEQ ID NO: 204577 - DNA, 2797 bp, Homo sapiens
  Payload ID: 20351
  Gene Name: zinc finger, HIT-type containing 6
  Uniprot ID: Q9NWK9
  ENST ID: ENST00000370574
  CDS Start-End: 135-1547
gctattccgggtttgtggctgcttggctccacacgtgggccgccgtaggtattccgaccggtaattcctcctattggtgtgcagcagccacattgaaggatagagtggcagcagaggccaaggatcgtgagttgatggagtttgctgctgaaaatgaagggaagtctgggggaggtctccacagcgtagctgagggggtgcggctaagtccagagcctggcagggagggagtaagggacttagcaggggcggaggagttcggcggcggagaggaggggacagggctgacagggataaaggagataggggatggagaggaaggaagtggacaaaggccagaggaaataccgatggacctaacggtagtgaagcaggaaattatagactggccaggtacagaaggcaggttggctggccagtgggtagaacaggaggtggaggataggcctgaggtgaaggatgagaacgcaggcgtattggaggtgaagcaggagacggatagtagtttagtggtaaaagaagcgaaggtgggtgaaccagaggtaaaggaagagaaggtaaaggaagaggtaatggactggtcagaagtgaaggaagagaaggataacttggagataaaacaggaggagaagtttgttggtcaatgcataaaagaggaattgatgcatggagagtgtgtaaaagaagagaaggatttcctgaagaaagaaatcgtggatgatacaaaggtgaaagaagagcctccgataaatcacccggtgggctgcaagcggaaactggccatgtcaaggtgtgagacttgtggtacagaagaagcaaagtacagatgtccacgttgtatgcgatattcctgcagtttgccctgtgtaaagaaacacaaagcagaactgacatgtaatggagttcgagataaaactgcatacatttcaatacaacagtttactgaaatgaatctcctaagtgattatcgatttttggaagatgtggcaagaacagcggaccatatttctagagatgcttttttgaagagaccaataagcaataaatatatgtactttatgaaaaatcgtgcccggaggcaaggtattaacttaaaacttctacccaatggattcaccaagaggaaggagaattcaaccttttttgataagaaaaaacaacagttttgttggcatgtgaagctccagtttcctcaaagtcaagctgagtacatagaaaaaagagtaccagatgataaaactattaatgaaatcctaaaaccttacattgatcctgaaaagtctgatcctgtaattcgtcaaaggttgaaagcctacattcgctctcagactggggttcagattttaatgaagattgaatatatgcagcaaaatttagtaagatattatgaactagatccttataaaagtctcctagacaatttgaggaacaaagtgatcattgagtatccaacattacatgtggtattgaaaggatccaataatgacatgaaagttcttcaccaagtgaagagtgaatctaccaagaacgttggcaatgaaaattgagcattttttctggaagaagaaagtgaaaacttccagacaactgcagcagactctgcattgatgggctgttggctgattggggtattgtcaatgggtgattggaattttttctttgtatgaaaaataagcttaactcttttaaaaaatgtattttataacctcttgaattaattgacttgtaagacccatttattcatattaagaactctcctttgcacttgatcagcatagtacttattaggccctggctttttaatatgcttaattgcttaattccataaactgaaaactttttttttcttttttctttctttttttgagatggggtcttggagtgcaagtggtatgagcatagcttcctcaaattcctgggctcgaatggtcctctcactgcagcctcccaacaggctggtaccaccacactcagctaagttttttgttgttgtttttttttggtagagacagggttgcgctctttcgcccaggctggtctcaaatttgtggcctcaagcaatccttccacctcagactccaaagcattgggattacaggcatcagccaccacacctggccttgaacattttttatttgttaatttcatgcgtgacgaaacccaaggatcacccatgtcaaccacaaagttggcattccctttagtagaacctcactaaacggaaaggctgtacaacgcaccgtctagccacaggagaactaatcttctatcagttgccctttcttctttggagtttttatgtaacttacccttgtgagacaagttttctacttgagaaactcctagtacaatgtcttatactagaagcctggataaatactattaactactgtttcttatattcacttcagaaaatcagtggctccacattgtttgagccattagtgataacaaatttggatctacttactcaagtcttatgaattctgtgcctttcatcacattcctagcccactctcatcattactgcagaagggtgttgtgatgaccagttttatactgtgttttgatatgtctagcaataacttaaagaaaaaaaaacctgggaaatcttcaacatgttattggaacatatatgtatgtattaatgtatatacatggcttaacttatacgttatggcagctctgtatacagtttgatctcatgtactgaaaaaaaattcttaattttattggagtttataccactgtgaaactgcaatatgactgtaagagagtaaaaagattgttacatcta

SEQ ID NO: 204578 - DNA, 6080 bp, Homo sapiens
  Payload ID: 20351
  Gene Name: zinc finger, HIT-type containing 6
  Uniprot ID: Q9NWK9
  ENST ID: ENST00000431532
  CDS Start-End: 150-1445
agtcgcgtcaagcaggctattccgggtttgtggctgcttggctccacacgtgggccgccgtaggtattccgaccggtaattcctcctattggtgtgcagcagccacattgaaggatagagtggcagcagaggccaaggatcgtgagttgatggagtttgctgctgaaaatgaagggaagtctgggggaggtctccacagcgtagctgagggggtgcggctaagtccagagcctggcagggagggagtaagggacttagcaggggcggaggagttcggcggcggagaggaggggacagggctgacagggataaaggagataggggatggagaggaaggaagtggacaaaggccagaggaaataccgatggacctaacggtagtgaagcaggagacggatagtagtttagtggtaaaagaagcgaaggtgggtgaaccagaggtaaaggaagagaaggtaaaggaagaggtaatggactggtcagaagtgaaggaagagaaggataacttggagataaaacaggaggagaagtttgttggtcaatgcataaaagaggaattgatgcatggagagtgtgtaaaagaagagaaggatttcctgaagaaagaaatcgtggatgatacaaaggtgaaagaagagcctccgataaatcacccggtgggctgcaagcggaaactggccatgtcaaggtgtgagacttgtggtacagaagaagcaaagtacagatgtccacgttgtatgcgatattcctgcagtttgccctgtgtaaagaaacacaaagcagaactgacatgtaatggagttcgagataaaactgcatacatttcaatacaacagtttactgaaatgaatctcctaagtgattatcgatttttggaagatgtggcaagaacagcggaccatatttctagagatgcttttttgaagagaccaataagcaataaatatatgtactttatgaaaaatcgtgcccggaggcaaggtattaacttaaaacttctacccaatggattcaccaagaggaaggagaattcaaccttttttgataagaaaaaacaacagttttgttggcatgtgaagctccagtttcctcaaagtcaagctgagtacatagaaaaaagagtaccagatgataaaactattaatgaaatcctaaaaccttacattgatcctgaaaagtctgatcctgtaattcgtcaaaggttgaaagcctacattcgctctcagactggggttcagattttaatgaagattgaatatatgcagcaaaatttagtaagatattatgaactagatccttataaaagtctcctagacaatttgaggaacaaagtgatcattgagtatccaacattacatgtggtattgaaaggatccaataatgacatgaaagttcttcaccaagtgaagagtgaatctaccaagaacgttggcaatgaaaattgagcattttttctggaagaagaaagtgaaaacttccagacaactgcagcagactctgcattgatgggctgttggctgattggggtattgtcaatgggtgattggaattttttctttgtatgaaaaataagcttaactcttttaaaaaatgtattttataacctcttgaattaattgacttgtaagacccatttattcatattaagaactctcctttgcacttgatcagcatagtacttattaggccctggctttttaatatgcttaattgcttaattccataaactgaaaactttttttttcttttttctttctttttttgagatggggtcttggagtgcaagtggtatgagcatagcttcctcaaattcctgggctcgaatggtcctctcactgcagcctcccaacaggctggtaccaccacactcagctaagttttttgttgttgtttttttttggtagagacagggttgcgctctttcgcccaggctggtctcaaatttgtggcctcaagcaatccttccacctcagactccaaagcattgggattacaggcatcagccaccacacctggccttgaacattttttatttgttaatttcatgcgtgacgaaacccaaggatcacccatgtcaaccacaaagttggcattccctttagtagaacctcactaaacggaaaggctgtacaacgcaccgtctagccacaggagaactaatcttctatcagttgccctttcttctttggagtttttatgtaacttacccttgtgagacaagttttctacttgagaaactcctagtacaatgtcttatactagaagcctggataaatactattaactactgtttcttatattcacttcagaaaatcagtggctccacattgtttgagccattagtgataacaaatttggatctacttactcaagtcttatgaattctgtgcctttcatcacattcctagcccactctcatcattactgcagaagggtgttgtgatgaccagttttatactgtgttttgatatgtctagcaataacttaaagaaaaaaaaacctgggaaatcttcaacatgttattggaacatatatgtatgtattaatgtatatacatggcttaacttatacgttatggcagctctgtatacagtttgatctcatgtactgaaaaaaaattcttaattttattggagtttataccactgtgaaactgcaatatgactgtaagagagtaaaaagattgttacatctatattgtatgtgtgtacttaatggttaaaaagcaatgataaaactggacattaatgaaattgatttttagttacagttggaataagttttttaccaaaaagaaaccagagacgttagttaaggagacttaaaaagatctgaaatatgaaaagagaatgagaagatgagcagaagataaatttgtgggacacaagtataacttggggtagaaactggagaagagaatcgaaaaacaataatgccagaaggacccttggtatgaaagtactaatggaatgtgattcatagaaagttcatagaaagtgagtccttgcaacttgagaaacatacatacatatatatttataatctctaaagcaacatcaggaatcttctaatatatgataaagaatttgtgtagaattacgttgttcacagtattattggagagacaaataagatttcaaggaattcatttataatcaaaagtgaaatgtgtcttcttgaaaccagcaagaaatagatgaattgagtgaaacgtgttgttattaggagaagtgggataacgtatacaaaaagaacttgcgatctgaatatgatctgaatatgagggtggataggaattttttgacagtgaaatctgttatgatgtagtctcatttccaagaaaagtcttgagttccatccccccttctgaatttaaattgaaacctggacagaaaacaaactatcctgtagtttccactgctcaggaggaaaaaaagaaatctatattatctaatgcatctttgccatctttattttctagaattctattagacttttcaattataggctattaggaaagaatataactcttagaattcccctaaatataattatcaactcatttgattaatatgcatattttttcccgtaagatttacaatacacgtgtgttttagtgaattaccaatggcttggagagaatgaaattggaataactaactgaaaaccctagatgtttgtagcattgagacccaatatctttttggaggccctctccatgttagcttattgtcaaattctggtgtgtaaacaaactccttgacccatgttaagttcagcatcctgcattttgttcatgaatcacattttaaaaggagaaaagctccacctggttttctttatttttttaaacagtgatttcaaagagaagataggcctttcataattgctaattatacatataggattaatagtcataaattatagtaaataaaacttgtacctattccttttataaatatgaattggctaggcacagtggctcacagctgtaatcccagcactttgggaggctgaggcgggcagatcacaaggtcaggtgtttgagactagcctggccaacatggcaaaaccctgtgtctactaaaaatacaaaaattagccaggcgtggtggcaggcacctgtaattccagctactcaggaagctggggcacgagaatcacttgaaccctggtggcagagtttgcagtgagctgagattgttccactgcattcctgggcactgcctgggtgacagaatgagactctgcctcaaaaaaaaaaaaagttattaaaaatagatatttaagattccaaaatgtagttgatccagtttgtttccctgtagcaagtagtgggatttgggtttcatgacatataattaaaatgttaatcacataactataatgccaacaattttctttatacatttttgtttaattatgttgacatatactttgtgttgtaccttatttcatgttactaaattttacataaagatgctggtctatttttatttaatcatatactgttatggtttgaatatagtttgttcctaccaaaactcatgttgaaattagattccccatgtgctagtgttgggaggcagagcctaatggaaggtgtttgggtcatgggggcagatagatcccacatgaataaactaatgccctcctactggggtgagtgagttctcattcttgctgtcgtgggaatggattagttctcacaagcaagggttactaaagagtctggctttcttgattttctcctttttgcctcctgccttcccatgtgatctctttgcacatacctactcccctttcactttgtaccaagagtggaagcaacatgagaccctcaccagatacagctgcccaatcttgagccttccagccaccagaatcatgagccaaataaaactctttttaaaaataagttacccagtcttagatattctattatagcgacacaaaatggactaagctgtactctgttgcattaaaatgtgttgtttatatgcaagtgacaaaaactcaaaatagtgtcagcatgaagggcagttcattggcttatatacagggaagtccaggcaatgactgggtcctgggtccaaacgtcaaaagcagtcatcttgccatcctacacacttggctctgattattttcttctttatggattggttttcttttcagattttccctttggggatattctgtatgggatgaggaacagtgaggtgagaggatggtggataacagcaattgacattttcagcttaccttagcataacaaggctgaaagcttttataaagcaagctatgtaaaattttggagaagtacttttattttgcccagattggatcacattccgttcctgagctaatcaagagaggaattcacccaaaggagggggaaatttttagaagaaagccagaatgtagggagcaggtgaggaaaggtagttactgggaatacgaaagtaacacattcattgcaccctgtttgaatttgagtagcaagaagtttctgatttgtactaacagaaggagtaaagttcagatttaatctgcaagtcttgattgtttttaactagagattttaatctcttcttcttattattgctgctttgagttgccattataggtttttggattttttttttaatgccatccatttttatttgacatcatgttgttgctagtttgagcagatgcacatagcatatgtttccattaccaatttggaaatttttcccagtggcatcagcatttgagagatactgattttgaaattagagtactaggggaaaatgcttcaaaaatgaagactacttaaataaaaattggctttaaataaacctttggggatctgtacttgactaaaaagtattttctttaaactttggtctttgaaaactaaagtgtgtgtgcatgtgttcattaaaatgacctataacatgaacattttccatactggagtgtgatgtactgtactcattttgaactttagaaccaaatgcatcctttagcatttgatgagctgctatataattctatttccagttttattttcttgccaaataaagtaccaaagctca

SEQ ID NO: 204579 - DNA, 2226 bp, Homo sapiens
  Payload ID: 20352
  Gene Name: zinc finger, imprinted 2
  Uniprot ID: Q9NZV7
  ENST ID: ENST00000599935
  CDS Start-End: 549-2132
ggtgcagaagtctgggcagctgcgggaggagaggtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagatacctgtgttttgactctgttcctgtggatagctgcttggtctgaagttccagaaaggatcctgttcccagacagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtttccttgctcaggactctgtccctgcagaaaagaggaacacagagatgttagacaatctgccatctgctgggtcccagttcccggacttcaaacacttaggaacatttctggtgtttgaggagttggtgaccttcgaggatgtgcttgtggacttcagcccagaggaacttagttcccttagtgctgctcagagaaacctctacagggaggtgatgctggagaattaccggaacctggtctccctggggcaccagttctctaaacctgacattatctcacgcctggaagaggaggaatcatatgcaatggagacagacagcagacatacagtgatttgtcaaggagagtctcatgatgatccattggaaccacaccagggcaaccaagagaaacttttgactcctataacaatgaatgaccccaagaccctcactccggaaagaagctatggcagtgatgaatttgagagaagctctaatcttagtaaacaatcaaaggatcctctaggaaaggatccccaggaaggcactgctcctggaatatgtacgagtccccagtcagcatcccaagagaacaaacacaacagatgtgaattttgcaaacgaacctttagtacgcaagtagcccttaggagacacgaacggatccatactgggaagaaaccctatgaatgtaaacagtgtgctgaagccttctatctcatgccacacctcaacagacatcagaagacccattctggtaggaagacttctggctgcaatgaaggtagaaagccttccgtccagtgtgcgaatctctgtgaacgtgtaagaattcacagtcaggaggactactttgaatgttttcagtgcggcaaagcttttctccagaatgtgcatcttcttcaacatctcaaagcccatgaggcagcaagagtccttcctcctgggttgtcccacagcaagacatacttaattcgttatcagcggaaacatgactacgttggagagagagcctgccagtgttgtgactgtggcagagtcttcagtcggaattcatatctcattcagcattatagaactcacactcaagagaggccttaccagtgtcagctatgtgggaaatgtttcggccgaccctcatacctcactcaacattatcaactccattctcaagagaaaactgttgagtgcgatcactgttgagaaacctttagtcacagcacacacttttctcaacattattggcttcctcctagagtgttgtgagtgtgagaaggcctttcactagccccacctt

SEQ ID NO: 204580 - DNA, 483 bp, Homo sapiens
  Payload ID: 20352
  Gene Name: zinc finger, imprinted 2
  ENST ID: ENST00000593931
  CDS Start-End: 38-238
tgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcagtgagtcttaaccactttctttcccagtaggagatatagagcatgtgctgtgcacaggttcaaggggaaagtgccagggcctcgaagtttctgctgctccatttggagtatattccgcttccccaaaagtttagtccaaggctcgtatttttgaagttccactcggtaccaccagcacaggtttcaccacatagacctgttgccacctaaactatttgctcagtattcttaagctggtgcattaaaaaaaaaaaaa

SEQ ID NO: 204581 - DNA, 2054 bp, Homo sapiens
  Payload ID: 20352
  Gene Name: zinc finger, imprinted 2
  ENST ID: ENST00000595671
  CDS Start-End: 212-793
cttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggagtgcagcttgctgaagacgatggccactcccacatgacgcagggccactcatcaagatccaagagaagtgcctacccaagcaccagtcgaggtttccttgctcaggactctgtccctgcagaaaagaggaacacagagatgttagacaatctgccatctgctgggtcccaggtgggaccctgaggcttaacctacccaaactcacaaagaaccagagccaggactctgattcctgaggctgagttcccggacttcaaacacttaggaacatttctggtgtttgaggagttggtgaccttcgaggatgtgcttgtggacttcagcccagaggaacttagttcccttagtgctgctcagagaaacctctacagggaggtgatgctggagaattaccggaacctggtctccctggggcaccagttctctaaacctgacattatctcacgcctggaagaggaggaatcatatgcaatggagacagacagcagacatacagtgatttgtcaaggagagtctcatgatgatccattggaaccacaccagggcaaccaagagaaacttttgactcctataacaatgaatgaccccaagaccctcactccggaaagaagctatggcagtgatgaatttgagagaagctctaatcttagtaaacaatcaaaggatcctctaggaaaggatccccaggaaggcactgctcctggaatatgtacgagtccccagtcagcatcccaagagaacaaacacaacagatgtgaattttgcaaacgaacctttagtacgcaagtagcccttaggagacacgaacggatccatactgggaagaaaccctatgaatgtaaacagtgtgctgaagccttctatctcatgccacacctcaacagacatcagaagacccattctggtaggaagacttctggctgcaatgaaggtagaaagccttccgtccagtgtgcgaatctctgtgaacgtgtaagaattcacagtcaggaggactactttgaatgttttcagtgcggcaaagcttttctccagaatgtgcatcttcttcaacatctcaaagcccatgaggcagcaagagtccttcctcctgggttgtcccacagcaagacatacttaattcgttatcagcggaaacatgactacgttggagagagagcctgccagtgttgtgactgtggcagagtcttcagtcggaattcatatctcattcagcattatagaactcacactcaagagaggccttaccagtgtcagctatgtgggaaatgtttcggccgaccctcatacctcactcaacattatcaactccattctcaagagaaaactgttgagtgcgatcactgttgagaaacctttagtcacagcacacacttttctcaacattattggcttcctcctagagtgttgtgagtgtgagaaggcctttcactagccccacctt

SEQ ID NO: 204582 - DNA, 1965 bp, Homo sapiens
  Payload ID: 20352
  Gene Name: zinc finger, imprinted 2
  Uniprot ID: Q9NZV7
  ENST ID: ENST00000601070
  CDS Start-End: 288-1871
cttggagacgactggcgagaggaagagggactaggtccaaacgctaggtggctgggtccagatacctgtgttttgactctgttcctgtggatagctgcttggtctgaagttccagaaaggatcctgttcccagacagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtttccttgctcaggactctgtccctgcagaaaagaggaacacagagatgttagacaatctgccatctgctgggtcccagttcccggacttcaaacacttaggaacatttctggtgtttgaggagttggtgaccttcgaggatgtgcttgtggacttcagcccagaggaacttagttcccttagtgctgctcagagaaacctctacagggaggtgatgctggagaattaccggaacctggtctccctggggcaccagttctctaaacctgacattatctcacgcctggaagaggaggaatcatatgcaatggagacagacagcagacatacagtgatttgtcaaggagagtctcatgatgatccattggaaccacaccagggcaaccaagagaaacttttgactcctataacaatgaatgaccccaagaccctcactccggaaagaagctatggcagtgatgaatttgagagaagctctaatcttagtaaacaatcaaaggatcctctaggaaaggatccccaggaaggcactgctcctggaatatgtacgagtccccagtcagcatcccaagagaacaaacacaacagatgtgaattttgcaaacgaacctttagtacgcaagtagcccttaggagacacgaacggatccatactgggaagaaaccctatgaatgtaaacagtgtgctgaagccttctatctcatgccacacctcaacagacatcagaagacccattctggtaggaagacttctggctgcaatgaaggtagaaagccttccgtccagtgtgcgaatctctgtgaacgtgtaagaattcacagtcaggaggactactttgaatgttttcagtgcggcaaagcttttctccagaatgtgcatcttcttcaacatctcaaagcccatgaggcagcaagagtccttcctcctgggttgtcccacagcaagacatacttaattcgttatcagcggaaacatgactacgttggagagagagcctgccagtgttgtgactgtggcagagtcttcagtcggaattcatatctcattcagcattatagaactcacactcaagagaggccttaccagtgtcagctatgtgggaaatgtttcggccgaccctcatacctcactcaacattatcaactccattctcaagagaaaactgttgagtgcgatcactgttgagaaacctttagtcacagcacacacttttctcaacattattggcttcctcctagagtgttgtgagtgtgagaaggcctttcactagccccacctt

SEQ ID NO: 204583 - DNA, 2037 bp, Homo sapiens
  Payload ID: 20352
  Gene Name: zinc finger, imprinted 2
  ENST ID: ENST00000597281
  CDS Start-End: 288-776
cttggagacgactggcgagaggaagagggactaggtccaaacgctaggtggctgggtccagatacctgtgttttgactctgttcctgtggatagctgcttggtctgaagttccagaaaggatcctgttcccagacagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtttccttgctcaggactctgtccctgcagaaaagaggaacacagagatgttagacaatctgccatctgctgggtcccaggtgggaccctgaggcttaacctacccaaactcacaaagaaccagagccaggactctgattcctgaggctgagttcccggacttcaaacacttaggaacatttctggtgtttgaggagttggtgaccttcgaggatgtgcttgtggacttcagcccagaggaacttagttcccttagtgctgctcagagaaacctctacagggaggtgatgctggagaattaccggaacctggtctccctggggcaccagttctctaaacctgacattatctcacgcctggaagaggaggaatcatatgcaatggagacagacagcagacatacagtgatttgtcaaggagagtctcatgatgatccattggaaccacaccagggcaaccaagagaaacttttgactcctataacaatgaatgaccccaagaccctcactccggaaagaagctatggcagtgatgaatttgagagaagctctaatcttagtaaacaatcaaaggatcctctaggaaaggatccccaggaaggcactgctcctggaatatgtacgagtccccagtcagcatcccaagagaacaaacacaacagatgtgaattttgcaaacgaacctttagtacgcaagtagcccttaggagacacgaacggatccatactgggaagaaaccctatgaatgtaaacagtgtgctgaagccttctatctcatgccacacctcaacagacatcagaagacccattctggtaggaagacttctggctgcaatgaaggtagaaagccttccgtccagtgtgcgaatctctgtgaacgtgtaagaattcacagtcaggaggactactttgaatgttttcagtgcggcaaagcttttctccagaatgtgcatcttcttcaacatctcaaagcccatgaggcagcaagagtccttcctcctgggttgtcccacagcaagacatacttaattcgttatcagcggaaacatgactacgttggagagagagcctgccagtgttgtgactgtggcagagtcttcagtcggaattcatatctcattcagcattatagaactcacactcaagagaggccttaccagtgtcagctatgtgggaaatgtttcggccgaccctcatacctcactcaacattatcaactccattctcaagagaaaactgttgagtgcgatcactgttgagaaacctttagtcacagcacacacttttctcaacattattggcttcctcctagagtgttgtgagtgtgagaaggcctttcactagccccacctt

SEQ ID NO: 204584 - DNA, 2083 bp, Homo sapiens
  Payload ID: 20352
  Gene Name: zinc finger, imprinted 2
  Uniprot ID: Q9NZV7
  ENST ID: ENST00000593711
  CDS Start-End: 364-1947
cgggaggagaggtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtttccttgctcaggactctgtccctgcagaaaagaggaacacagagatgttagacaatctgccatctgctgggtcccagttcccggacttcaaacacttaggaacatttctggtgtttgaggagttggtgaccttcgaggatgtgcttgtggacttcagcccagaggaacttagttcccttagtgctgctcagagaaacctctacagggaggtgatgctggagaattaccggaacctggtctccctggggcaccagttctctaaacctgacattatctcacgcctggaagaggaggaatcatatgcaatggagacagacagcagacatacagtgatttgtcaaggagagtctcatgatgatccattggaaccacaccagggcaaccaagagaaacttttgactcctataacaatgaatgaccccaagaccctcactccggaaagaagctatggcagtgatgaatttgagagaagctctaatcttagtaaacaatcaaaggatcctctaggaaaggatccccaggaaggcactgctcctggaatatgtacgagtccccagtcagcatcccaagagaacaaacacaacagatgtgaattttgcaaacgaacctttagtacgcaagtagcccttaggagacacgaacggatccatactgggaagaaaccctatgaatgtaaacagtgtgctgaagccttctatctcatgccacacctcaacagacatcagaagacccattctggtaggaagacttctggctgcaatgaaggtagaaagccttccgtccagtgtgcgaatctctgtgaacgtgtaagaattcacagtcaggaggactactttgaatgttttcagtgcggcaaagcttttctccagaatgtgcatcttcttcaacatctcaaagcccatgaggcagcaagagtccttcctcctgggttgtcccacagcaagacatacttaattcgttatcagcggaaacatgactacgttggagagagagcctgccagtgttgtgactgtggcagagtcttcagtcggaattcatatctcattcagcattatagaactcacactcaagagaggccttaccagtgtcagctatgtgggaaatgtttcggccgaccctcatacctcactcaacattatcaactccattctcaagagaaaactgttgagtgcgatcactgttgagaaacctttagtcacagcacacacttttctcaacattattggcttcctcctagagtgttgtgagtgtgagaaggcctttcactagccccaccttgttaacaacttgaacattcatcaaagtgtggtaaaaaaaaaa

SEQ ID NO: 204585 - DNA, 2253 bp, Homo sapiens
  Payload ID: 20352
  Gene Name: zinc finger, imprinted 2
  Uniprot ID: Q9NZV7
  ENST ID: ENST00000629319
  CDS Start-End: 544-2127
ggtgcagaagtctgggcagctgcgggaggagaggtttgggaggcgcgggagatgtccaccctgggctggtggcgccgccgggcgccgggcgccatgagggtgcgctaggcggctgttcgtgcccgaggctgcgcagcactgagctttgccttcttgatcttccgtccttcttggagacgactggcgagaggaagagggactaggtccaaacgctaggtggctgggtccagatacctgtgttttgactctgttcctgtggatagctgcttggtctgaagttccagaaaggatcctgttcccagacagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtttccttgctcaggactctgtccctgcagaaaagaggaacacagagatgttagacaatctgccatctgctgggtcccagttcccggacttcaaacacttaggaacatttctggtgtttgaggagttggtgaccttcgaggatgtgcttgtggacttcagcccagaggaacttagttcccttagtgctgctcagagaaacctctacagggaggtgatgctggagaattaccggaacctggtctccctggggcaccagttctctaaacctgacattatctcacgcctggaagaggaggaatcatatgcaatggagacagacagcagacatacagtgatttgtcaaggagagtctcatgatgatccattggaaccacaccagggcaaccaagagaaacttttgactcctataacaatgaatgaccccaagaccctcactccggaaagaagctatggcagtgatgaatttgagagaagctctaatcttagtaaacaatcaaaggatcctctaggaaaggatccccaggaaggcactgctcctggaatatgtacgagtccccagtcagcatcccaagagaacaaacacaacagatgtgaattttgcaaacgaacctttagtacgcaagtagcccttaggagacacgaacggatccatactgggaagaaaccctatgaatgtaaacagtgtgctgaagccttctatctcatgccacacctcaacagacatcagaagacccattctggtaggaagacttctggctgcaatgaaggtagaaagccttccgtccagtgtgcgaatctctgtgaacgtgtaagaattcacagtcaggaggactactttgaatgttttcagtgcggcaaagcttttctccagaatgtgcatcttcttcaacatctcaaagcccatgaggcagcaagagtccttcctcctgggttgtcccacagcaagacatacttaattcgttatcagcggaaacatgactacgttggagagagagcctgccagtgttgtgactgtggcagagtcttcagtcggaattcatatctcattcagcattatagaactcacactcaagagaggccttaccagtgtcagctatgtgggaaatgtttcggccgaccctcatacctcactcaacattatcaactccattctcaagagaaaactgttgagtgcgatcactgttgagaaacctttagtcacagcacacacttttctcaacattattggcttcctcctagagtgttgtgagtgtgagaaggcctttcactagccccaccttgttaacaacttgaacattcatcaaagtgtggt

SEQ ID NO: 204586 - DNA, 2627 bp, Homo sapiens
  Payload ID: 20353
  Gene Name: zinc finger, imprinted 3
  Uniprot ID: Q96PE6
  ENST ID: ENST00000269834
  CDS Start-End: 387-1805
ttccattggaaactgattgggcagatttgaaaattaagctttcacaatcacaatttttatgagagttcattcagttttggagaagtcgaggaaagaattgggaattgaaattttgatgtggcctgataggatcaggtggggcttttgataggaagtgagtgttttgggttgtttcttgactggattatgatgcggaatacagcgggtagagggccgattaagttttagtcattagtgtagcttttcagtatacacgccttttcattttcagtccctttcagaagaaaagaccacaggcatcagaaatcaatcaacttgctaatttatgccagattccactggagatctgccttcccaagactttactgactggtgaagaacaggaaatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcgcaagagaagtcccatcaatcaataaggaaacgctgactacgcagaaaggtgtagaatgtgacggatctaagaaaatacttccactgggcatagatgatgtatcttccttgcaacactatgtacaaaataattctcacgatgataatggatacagaaaattagttggcaataatccatccaaatttgtaggacaacaactgaaatgtaatgcctgtagaaagttattcagttcaaagtcacgccttcaaagtcacctgaggaggcatgcctgtcaaaaaccctttgaatgtcatagctgtggaagagcattcggggagaagtggaagcttgataaacatcagaaaactcacgcagaggaaaggccctataaatgtgagaactgtggaaatgcctacaagcagaagtcaaatctctttcaacatcagaaaatgcatactaaagagaaaccctatcagtgtaagacatgtggaaaagccttttcctggaaatcatcctgcattaatcatgagaaaattcataatgccaagaaatcctatcagtgtaatgaatgtgagaaatccttcaggcagaactcaaccctcattcaacataaaaaagttcacactggacaaaaaccctttcaatgtacggactgtggaaaggctttcatttacaagtcagatcttgtgaaacaccagagaatacacacgggagagaaaccctataaatgtagcatatgtgagaaggccttttcccagaaatccaatgtcatcgatcatgagaaaattcacactgggaagagagcttatgagtgtgatctatgtggaaatacctttatccagaagaaaaacctcattcaacataaaaaaatccatactggggaaaagccctatgaatgtaacagatgtggaaaagccttctttcagaagtcaaaccttcatagccatcagaaaactcatagcggagagaggacctatagatgtagtgaatgtggaaaaaccttcatccggaaattaaaccttagtttgcataaaaaaacccatactggacaaaaaccttatggatgttctgaatgcggtaaagccttcgctgacaggtcataccttgttaggcaccagaaaagaattcactccagataggagccccatgcacttaaaaaaacatgggaagatatggttgcctggaattgtcaccccagaattccatgttgaaatggcctctaatttggaggctatttttgaaggtagcgaggacttattatcacagtatcctttgaaaacccattcggcatactcactcagcaaatgtttattaagtataaatatttattagatgccttttgtgtaccaggaactcttaaacactgaagatgtagcaataaaccaaatgtgctaaaaccctgatggagttttattccagtgaataatgaccagtggtatccatatctttaaaaacgtttaaaagactatacttttggccaggcgtggtggctcaaatgcctgtaatcccagtactttgggaggctgaggtgggcgcatcacctgaggtcaggagttcgagaccagcatgaccaacatggtgaaaccctgtctctaccaaaaatacaaaaattagccaggcatagttgtgggcacctgtaatcccagctacccgggaggctgaggcaggagaattgcttgaacctgggaggtagaggttgcagtgagccaatattgcaccattgcactcctgcctgggcaacaagagcaaaatttcatctcaaaaataagataaaataaaataaacaaataagacagcactttatacttttagggatgatttctataattcatgagtggagaggtttctctagaggtgtaggggactggaaaccacatccaggaagtacagctttctctcctgagcatgaaggtatcttggcatttcttcactgcaattgccatttgccttttttgtttttc

SEQ ID NO: 204587 - DNA, 3185 bp, Homo sapiens
  Payload ID: 20354
  Gene Name: zinc finger, matrin-type 1
  Uniprot ID: Q5H9K5
  ENST ID: ENST00000372782
  CDS Start-End: 49-1965
gggggggcagtagttttaaagtagacacccgcccttgcctcagagaagatggagtcttgctctgtcaccaggctggagtgcagtggcgcaatctcggctcactgcagcctccacctcccgggttcaagcgattcccctgcctcagcctcccaaatagctgggactacagacgccatttggaatgaacaggaaaaggctgaactttttacagataagttttgtcaagtatgtggagtgatgctacagtttgaatcacaaagaatttcacattatgagggtgaaaaacatgctcaaaatgttagtttttattttcaaatgcatggggaacaaaatgaagtgcctggtaagaaaatgaagatgcatgttgagaattttcaggtgcataggtatgaaggagtggacaaaaacaaattttgtgatctctgcaacatgatgtttagctctccacttattgctcagtctcactatgtgggaaaggtccatgctaaaaaactgaagcaattaatggaggaacatgatcaggcatctccatcaggatttcaaccagagatggcatttagtatgagaacctatgtttgccatatttgtagtattgcttttacatctttagatatgttccggtcccacatgcaaggaagtgaacatcaaattaaagaatccattgttatcaatctagtgaagaattcaaggaagacacaagactcttaccaaaatgagtgtgcagattacatcaatgtgcagaaagccagaggactagaggccaagacttgtttcagaaagatggaagagagttctttggaaacccgtagatacagagaagtggtcgattccagacccagacatagaatgtttgaacaaagactcccatttgagactttccggacatacgcagcaccatacaatatttcacaagcaatggaaaagcagttacctcattcaaagaagacatatgactctttccaagatgaacttgaagattacatcaaagtacagaaagccagaggactagatccaaagacttgtttcagaaagatgagagagaactctgtggatactcatgggtacagagaaatggttgattctggacccagatcaagaatgtgtgagcaaagattttcacatgaggcttcccagacctaccaacgaccataccatatttcaccagtggaaagccagttacctcagtggctaccaacccattcaaagaggacatatgattctttccaagatgaacttgaagattacataaaagtgcagaaagccagaggactagagccaaaaacttgtttcagaaagataggagatagctctgtagaaacacacaggaacagagaaatggttgatgtcagacccagacatagaatgttggagcaaaagctcccatgtgagactttccagacctattcaggaccatatagtatttcacaagtagtggaaaaccagttacctcattgcttaccagctcatgatagcaaacagagactagattctattagctactgtcaactcaccagagactgtttcccagaaaaaccagtacccttgagccttaatcagcaagaaaataactctggctcatacagtgtagaatctgaagtttacaagcacctctcttcagaaaacaatactgctgaccatcaagcaggtcataaacggaaacatcagaagagaaaacgacacctagaagaaggcaaagaaaggccagagaaagagcagtccaagcataaaaggaaaaagagttatgaagatacagatttagacaaagacaagagcatcagacaaaggaaaagagaggaggatagagtcaaggtcagttcaggaaagcttaagcatcgaaaaaagaaaaaaagccatgatgtaccctccgagaaagaagaacgtaagcacaggaaagagaaaaagaaatctgttgaagaaaggacagaagaggaaatgctttgggatgagtctattcttggattttgaatgtttagttttgtttacccaaggttgaattgaaaaaaaaaaacagtcaatatggatttagaaaaaggaacacctgatgaagaaaaggagaggtagatacagtcagtgtcacttcaggacacttaggttttttttgtataaaaatttaaattgaattaaaagaaggaaaaaaaaagcccaaacttaacctctgagaaaagaacataagaactcaaggagaacataagagaaaaggaaacctgttacagaaaagacaagaatctgtgttttggaatgagtctattcttgggtattgaacttttagttttgtttgcccaaggattaattgaggaaatcagctaagaaaatggactttagacaaaagcaagaggatcagatgaagaaaaggagaggtagatacagtcagtgtcacttcaggaaagctatttaaaaaaacttgaaatttaattgaaagaagaaacaacaacaaaaaagcctaaacctagcctctgaacaacactaacatgagaacacaagaacttaagagaaaaagaaacctactcaagaaaagacagaagagacagtgatttgggatgagtctactctaggattttcaactttttagttttgttccttcaaagttgaaggaaaaaaagtttggttttataaaattcatgttattgtaatttttctaggtggatggctactttaatctctaaaaaagccaagtgaagtaaaagtattcagtatgccttttcctcaagttactttccttcattttcttaaaaaagaaaaaaaattattaaatgtttctcacatatctcacatataatgtaatttccctaaatgaagttgtctctacttctgctcatcaaattgctgtgatagtgaattatttattcatgggagataatttattttaaaggacagaattaccaagcgttacaaaatcagttctttccttggttttgtgttagtgttggtggtattttattgttgtttttctgtgtttatgtgtctcagctttctccaaggaatatgtatgaaataacttaaactgattttttctttgttaaatctaatttgcagtgtatttttgcattttctagttctgaaagtggaaaatgaaacagtctataataaacttagatgatatatagttttaaaacggtctcaaaaagtactgatataaggtcagtctatattctggaaatgtttatattaaagtgttttaatttcta

SEQ ID NO: 204588 - DNA, 3139 bp, Homo sapiens
  Payload ID: 20354
  Gene Name: zinc finger, matrin-type 1
  Uniprot ID: Q5H9K5
  ENST ID: ENST00000540921
  CDS Start-End: 1-1917
atggagtcttgctctgtcaccaggctggagtgcagtggcgcaatctcggctcactgcagcctccacctcccgggttcaagcgattcccctgcctcagcctcccaaatagctgggactacagacgccatttggaatgaacaggaaaaggctgaactttttacagataagttttgtcaagtatgtggagtgatgctacagtttgaatcacaaagaatttcacattatgagggtgaaaaacatgctcaaaatgttagtttttattttcaaatgcatggggaacaaaatgaagtgcctggtaagaaaatgaagatgcatgttgagaattttcaggtgcataggtatgaaggagtggacaaaaacaaattttgtgatctctgcaacatgatgtttagctctccacttattgctcagtctcactatgtgggaaaggtccatgctaaaaaactgaagcaattaatggaggaacatgatcaggcatctccatcaggatttcaaccagagatggcatttagtatgagaacctatgtttgccatatttgtagtattgcttttacatctttagatatgttccggtcccacatgcaaggaagtgaacatcaaattaaagaatccattgttatcaatctagtgaagaattcaaggaagacacaagactcttaccaaaatgagtgtgcagattacatcaatgtgcagaaagccagaggactagaggccaagacttgtttcagaaagatggaagagagttctttggaaacccgtagatacagagaagtggtcgattccagacccagacatagaatgtttgaacaaagactcccatttgagactttccggacatacgcagcaccatacaatatttcacaagcaatggaaaagcagttacctcattcaaagaagacatatgactctttccaagatgaacttgaagattacatcaaagtacagaaagccagaggactagatccaaagacttgtttcagaaagatgagagagaactctgtggatactcatgggtacagagaaatggttgattctggacccagatcaagaatgtgtgagcaaagattttcacatgaggcttcccagacctaccaacgaccataccatatttcaccagtggaaagccagttacctcagtggctaccaacccattcaaagaggacatatgattctttccaagatgaacttgaagattacataaaagtgcagaaagccagaggactagagccaaaaacttgtttcagaaagataggagatagctctgtagaaacacacaggaacagagaaatggttgatgtcagacccagacatagaatgttggagcaaaagctcccatgtgagactttccagacctattcaggaccatatagtatttcacaagtagtggaaaaccagttacctcattgcttaccagctcatgatagcaaacagagactagattctattagctactgtcaactcaccagagactgtttcccagaaaaaccagtacccttgagccttaatcagcaagaaaataactctggctcatacagtgtagaatctgaagtttacaagcacctctcttcagaaaacaatactgctgaccatcaagcaggtcataaacggaaacatcagaagagaaaacgacacctagaagaaggcaaagaaaggccagagaaagagcagtccaagcataaaaggaaaaagagttatgaagatacagatttagacaaagacaagagcatcagacaaaggaaaagagaggaggatagagtcaaggtcagttcaggaaagcttaagcatcgaaaaaagaaaaaaagccatgatgtaccctccgagaaagaagaacgtaagcacaggaaagagaaaaagaaatctgttgaagaaaggacagaagaggaaatgctttgggatgagtctattcttggattttgaatgtttagttttgtttacccaaggttgaattgaaaaaaaaaaacagtcaatatggatttagaaaaaggaacacctgatgaagaaaaggagaggtagatacagtcagtgtcacttcaggacacttaggttttttttgtataaaaatttaaattgaattaaaagaaggaaaaaaaaagcccaaacttaacctctgagaaaagaacataagaactcaaggagaacataagagaaaaggaaacctgttacagaaaagacaagaatctgtgttttggaatgagtctattcttgggtattgaacttttagttttgtttgcccaaggattaattgaggaaatcagctaagaaaatggactttagacaaaagcaagaggatcagatgaagaaaaggagaggtagatacagtcagtgtcacttcaggaaagctatttaaaaaaacttgaaatttaattgaaagaagaaacaacaacaaaaaagcctaaacctagcctctgaacaacactaacatgagaacacaagaacttaagagaaaaagaaacctactcaagaaaagacagaagagacagtgatttgggatgagtctactctaggattttcaactttttagttttgttccttcaaagttgaaggaaaaaaagtttggttttataaaattcatgttattgtaatttttctaggtggatggctactttaatctctaaaaaagccaagtgaagtaaaagtattcagtatgccttttcctcaagttactttccttcattttcttaaaaaagaaaaaaaattattaaatgtttctcacatatctcacatataatgtaatttccctaaatgaagttgtctctacttctgctcatcaaattgctgtgatagtgaattatttattcatgggagataatttattttaaaggacagaattaccaagcgttacaaaatcagttctttccttggttttgtgttagtgttggtggtattttattgttgtttttctgtgtttatgtgtctcagctttctccaaggaatatgtatgaaataacttaaactgattttttctttgttaaatctaatttgcagtgtatttttgcattttctagttctgaaagtggaaaatgaaacagtctataataaacttagatgatatatagttttaaaacggtctcaaaaagtactgatataaggtcagtctatattctggaaatgtttatattaaagtgttttaatttctaca

SEQ ID NO: 204589 - DNA, 1647 bp, Homo sapiens
  Payload ID: 20355
  Gene Name: zinc finger, matrin-type 2
  Uniprot ID: Q96NC0
  ENST ID: ENST00000274712
  CDS Start-End: 128-727
agaaaccctccagtccttagctcgtttagaacacaagactccaagcttattggagggctatcttgccttacggctccaagccgctttttacggcgtttttcagctcgccattcacttcgctgtgaagatggcgtcgggcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaaagaaacatcagagaaacctgggcatgtctatgcgtgtggaacgttccaccctggatcaggtgaagaaacgttttgaggtcaacaagaagaagatggaagagaagcagaaggattatgattttgaggaaaggatgaaggagctcagagaagaggaggaaaaggccaaagcgtacaagaaagagaaacagaaggagaagaaaaggagggctgaggaggacttgacatttgaggaggacgatgagatggcagctgtgatgggcttctctggctttggttccaccaagaagagttactgaggctttctgtgcttggcctgactttggcctatgctggacctaactttgcgtgtgtgtgtgtgtagtagggggtcatttctttttgggtaatgggaaagttcttaagagtgtcaatggggagggatagagggtgggggctcatggtttccctctactttgggagagggcacagattgcagaggtaatgctgtggcatattgcttctgcctcagtgtatcactggagtcacaggaccctgcccacctgagttcccaataaagaaaaacctccccttctgaggctgctttcccaaaactccccctgcatctttatctcttcatctatcccacctcttgtctgaacatcccacctttatcctgtgttctgcctttgttttaattttaactcatgttcatcctgcaacagaagcattctctaggtcccagtttccagttgattgcatatccttgatcagccctttttcccatcctgccctatggttctctagccacctgtgcatgcatgtgtatttctgcctggttctatggtgtgtggatgtgtgtgcatgaatctgtcatatagagggggtccgagctggaatcctagagcattgctgccctggggcctgatgttcttggcttcctcagagcatgtaacaggaaattaaatgggatgagtgtttggtgtggtttgtgtctgatgagttttttaacattcaggtgtagattgtttcagcttctcatgtttcattttcctgaagatttatgtttttgtctaccttgtgagcaggcttttggaagaacctgtttgatgcaaaaaagaaaatgaaaaacaaaacaaaaaatccccaaaaccttattatgggagcccgtcggtcttagaagctgtttgacatgtataataaatggcattgactgggcctgttttacatttggtgagaa

SEQ ID NO: 204590 - DNA, 521 bp, Homo sapiens
  Payload ID: 20355
  Gene Name: zinc finger, matrin-type 2
  ENST ID: ENST00000519913
  CDS Start-End: 363-521
ccattcttcctgggtgcagaactgtagaagaccctgaggactcctgggctagtgtgagcagctattctgcatgggtgcagatggctggatgtgaaagagacatgctctagctgcagaggcaaatttgaagtgccacggaacgttgtcaagagacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaaagaaacatcagagaaacctgggcatgtctatgcgtgtggaacgttccaccctggatcaggtgaagaaacgttttgaggtcaac

SEQ ID NO: 204591 - DNA, 735 bp, Homo sapiens
  Payload ID: 20355
  Gene Name: zinc finger, matrin-type 2
  ENST ID: ENST00000506644
  CDS Start-End: 1-390
gcgtcgggcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaaagaaacgtaaggcttggagatcagagaaacctgggcatgtctatgcgtgtggaacgttccaccctggatcaggtgaagaaacgttttgaggtcaacaagaagaagatggaagagaagcagaaggattatgattttgaggaaaggatgaaggagctcagagaagaggaggaaaaggccaaagcgtacaagaaagagaaacagaaggagaagaaaaggagggctgaggaggacttgacatttgaggaggacgatgagatggcagctgtgatgggcttctctggctttggttccaccaagaagagttactgaggctttctgtgcttggcctgactttggcctatgctggacctaactttgcgtgtgtgtgtgtgtagtagggggtcatttctttttgggtaatgggaaagttcttaagagtgtcaatggggagggat

SEQ ID NO: 204592 - DNA, 9406 bp, Homo sapiens
  Payload ID: 20356
  Gene Name: zinc finger, matrin-type 3
  Uniprot ID: Q9HA38
  ENST ID: ENST00000311417
  CDS Start-End: 743-1612
ctccatcctggggcggaagtggggagagcagcagtttaaaggttctgttgcagcagtttaaaggatccactcagccgccttaaccgccaaccagcaggctaagggaggaacagaatgaacaatgtttggatcccaatgactggagatgaaagttgcaaaagctctgcccaggcttctaccaaggattaactttccagggcatctgctgaactgctcttcggggctgtctgctgagattggcggcgggaccctcccgcctctcactcgtgcctttgttccccacgccggcctaaccccgcgcccctgcgctcgcggccagggcacctgacccacgcgccgcccgccggggatgcgggagccgccactgctaccgctgccaccgctgccgggcctgctccgccaagcacatgcgcagtggcgacgccgagccggcgccctcagtctcctcctccaccgcctcccggttccgcagtcacttcctgcagctgtttccctgtgggtcgggttggactgacttttgacagtcagccttcggctgcggagggggctcggcggcggccggcggagaaagttgctccgagaagaggctgggtcgagctgggccgagccgggcgcgcagggcgggcgtcgcgggcgtcccgggcggacgcggcgcggagactgccggcgcgtcccgggggttccgatttgaagaccttgcttctcatcacccactggattatgccccaggcttccctacccaatgatcctcttgcaacacgccgtgcttcctccacctaagcagccctcaccctcgcctcctatgtcagtggccaccaggtctacaggaaccttgcagcttccaccacagaagccttttgggcaggaggcttccttgcctcttgcaggggaagaagagttatcgaagggaggggagcaagactgtgccctggaggagctatgtaagcccctgtactgcaaactctgcaatgtcaccttgaactctgcacagcaagcccaggctcattatcagggtaaaaatcatggtaagaaactccgaaattactatgcagcaaatagctgtcctcctcctgctagaatgagcaatgtggtcgagcctgcagctactccagttgttccagtccctccgcagatgggctcctttaagccaggaggccgagtgatcctggccacggagaatgattactgtaagctctgtgatgcctccttcagttccccagctgtggctcaggctcactatcaagggaagaatcatgccaagaggctgcggctggcggaagctcagagtaactcattctcggaatcctcagagctgggtcaacggcgggccaggaaagaagggaatgagtttaagatgatgcctaacaggagaaatatgtatacagtacagaataattcagcaggtccttacttcaatccccgctctcggcagagaattccacgtgatctggccatgtgtgttactccaagtggccagttttactgctcaatgtgtaatgttggagctggcgaagagatggaattccggcagcatttagagagcaagcaacataagagcaaggtgtctgaacagcggtacaggaatgagatggagaatctgggatatgtatagtgattatcatattaagatagagcagcttttcctgcctgttgtttgccttttgtcaacttgccctgctttgtggtctttttgatatgagtacattcctctgcttaatgttaatacatgtaacccacagtggtaccatgagatgtcaaaacctgggggcccgggggcggggcggggggaggtgggtgtgaagaacgtgcttcttaggtcataacgcttttgcagggtcaatggtgttgagccgctcatagcatgtgacctacctaccccatcagaaataactttttatcttgctcaagttctggtcaactagtagcctgacggcttagaactttgactatttaaaagtttcattttcttttgcaattttagttttatgtactgttaaagaattgtactgaattctttttagatcacagtaaaaataggttggcagagatttcagtttcccagggcttaaccagaaccgccacctcaatgcattgtcagtagaatacattattagaaactgttaaggtctttcccgggacatttttttctgccattttcttttgcaattgtagttttatgtactgttaaagaattgtattgaattctttttagatcaaagtaaaaataggtcagcagagatttcagtttcccagggcttaaccagaaccgccacctcaatgcattgtcagtaggatacattattagaaactgttagggtctttcccaggacatttttttttctgtatcatgtctccccatcattgaagcgcaaattttcttgaattcaaatactcccaatgagcttgtatacttccaaacagctaaacttgatttccagttgtggatttcacacatataattgccgccttcttccctcctcttttttcccccctagttgaatcagcttgtctaacaagcccattttcatgccccagctgtgctgtgggttttccaagcctcatatttgaatattcaatgagtttaagatggatatgatttcaaaaaatagggccgggcgcggtggctcacgcctgtaatcccagcactttgggaggccgaagcaggcggatcacgaggtcaggaggtcgagatcatcctggctaacacagtgaaaccccatctctactaaaaatacaaaacattagccgggcgtggtggtgggtgcctgtagtcccagctactctggaggctgaggcaggagaatggcgtgaacccgggaggcggagcttgcagtgagccgagatcgcgccactgcactccagcctgggtgacagagcgagactccgtctcaaaaaaaaaaaaaaaaaaaaaaaaaaaatatatatatatatagatatattttccagcagtttttaggaaacaaaggtgtgtttgattttccaatttagagttacttcattgatagtaacatgcgcttatatcatgatctaaaccataagttcagattgcttgatattttgttttgccagacttttttgataatctgattcttacggtttacttacattttcctctgtcttgccagtctggtggccatcctgaaaaatatcaccacctgctgttttatacacagaggaattttttaaaaagcaaataaagtttcactatcttcgtttccagtagaaatatacacgaactatggttttattctttgtaattcggctttcttgaagatactaacaagtatatgatagatcactttggcatctgataattatatcagtattattatttttgtttttttgcgtttaaaataagaagttgtatgaacccaggaggtggaggttgcagtcagccaagaatcgtgccactgcactccagtctgggcgacagagcaatactccgtctccaaaaaaaaaaaaaaagaagctataatatatatctagattaactaatggagtgctctgtgaatattcattaactacattttatctatttactatattttatatgggtaagaccagtggtcatccgtatttcttttgaaagcccacttgatcaggaagtttatattttaagcagtatgtttgcacaatggtcagttcacatttgattgcttgtattactaattagaggtaaaacttctattttttcttgataattctgtaggcaaaaaaaattggggaaggcaaattacaatcattcttcttctgtaatactttgggacaatttttaaacaactcagacccatgtttaaaaacgagttttgtgtgattaacccttgtatagtatccagttactgtcttctcttgaagtggtggttctttgagaagtagaattattttgtaacttttcttctcccagaaacagaagaatcaaatactattctgttaggattctatctagacctgtgactcttagtataataacccttttattattattattattattattttttcagtaatctataaagtagagttgcttagttttgagcaatttagggcttttcttattggccagtaggttattcattttgctgctaaatataattttttggttaattttaacattatagtgctggccgcttggttctatgattacctaaaaatctagtttttttcctccataggtagatgtgtgtgtatgcatacccccacacacacacgtacatatatgttgtcatagagaggtatttcaacccttatttcaaataacagtagaagatacgaacatgaatttatattttgtaaaaatgtcattcatccactttgttttccattggaaatagttttataagaagggttccccttgctctctccacttaacaatttcattatatacgtagaaaaagcagccgacttaagggcttgatgttttttcaggccttgtggattcaggtttccagtttcccagtgcccttaatggatgttatgaatgcataagcacattttcttttaaagaaagaagttagatttatagtgttatttcttacttgctatatttctttgcactaaaaaagagctatgtgtttgttttataggacactttagtaccgtattgcctacaataactcagtttgctccttaaattccaaactctgggaagttgataaataacttccatgatcacttgtaaaagttacatgcacatctgaaaaaaaatcacaaatctctatgacagtaggttatgttttgagcttgttaccttgcagtattcttctctgttccataggtgaaaacaaagggtgacagaggttatcaggcaggaaatgcctaaatagatacatctctgcatggtacaatttctcatattcatgtattccataaacagtgttttttctctgtttaagcagactgttgtttcttctgagtcagtgatatgtgatcttcgttggtttcattttgtgaagctcagtctgtctctgtaacatactttaggatttgcaccttgtgctccccaggaattatgttagtgtccttttctatgctgtcttcaaggatggacagaggcctaaaccacaacaacaacaaaaattagaaaaaaaaatacttagatttcggtaatcatccataggaactcatagcatcagtctcttttctctgtgaataatatctttgtgtaagttgtcataaaaaatcaacgttagaagatgacaattagaattcttcttaggtattgagggtaagaagttgtaaagaaagaaaattcgtgtttcaactaaaagattggattgcatatacctttgaagtggttttgtaaaaaaagttcagttactaaactgagtgtgccctgtaatccttttgagtgcactgaagatgctttgaaaatactttgttggtcttcacattgtgcatcatgtcctgcaacttgtaaatatgtgcatgttgtttatgtttgtctgcctgtctcttattgcactaaattctgcaaggtgaataatttttttataccatttatttggaaaaagttcctcctccaactcttcttcactgaccttttaattagttggtaaacttagaaaaccaggtaggatttttgaagccctgagtttaaaagaagaatcgtggctatttgacatcatccttacattcccctgacttaaaaagctaacaagaagcacgagatcttccacctcattttagaaagcttttctacagaactatatgcttgcttatagctacctatctacagtttgaacagggagaaagggagatatgtatgtctggttacatcttccttcactcttgaattggctgggacagcaagcaacaacagtttgaggtccagtgacctacgtaaaatgagtgtcgtttgtgtcaggggacacatgtaactgtgcaacatggtattttctacagggagggctaggaagggtggttttggaacctaacctactttgtgtcttcattgtcagaactaaggttggaaatgccctttaaagaacttggtgaggcatatgctaggacaatagagctgctttagaaagaaattgagacatgttttgtcaggacagataaaagtttaatgcaggcttttgaacagatgttttaaaacaaatttgaccttaccaactatttttttcttctagccaaatcattgtacaggagtttcatatatgataaaaagtgttttgttattgtttttgctttcttggcaggggagaacccctaccattgtgagcagttactgtcactctggctgaatggacaaatagctgtgtaaatagcttctcataaaacgcttctactgatagctgtttgactttttcttcccgttatgaatgggaggaacatttgtaaacttcctttctgggtagctaccaaaaaacgtactggcttatggtcccatgtgaccttgtctccgttaagcccagaatctgagtgcctttagcaagtgttagcatttcacagagagaagagagacagaattattgctattaatcaccattcataaataggagcttggaataacaaaggtctgtgtgaattctgttctacgtcttttttttcccttttttaaataaatgtcaatttgatatcaagtaaaactattgtcattattgatcagaaaccatacattctgaaaatgaatccagttttcccaagctggcagaagtcagagatcatttttcaccttgatctgtgttgcgtttgtacttagtgaatggcagtgtggttgattggaagagcttgacactgatgtttggaaaaattctttattctagtggtcattttcaaacttgtcttctgtagagaggggaaaaattatgtatttgcagctaaagcgaagagactggcacaataattattaattgtgttagttcatttctatattaaatgaagcatcttcacaaatcaggtttgaagccattaaaagcaaaattttccctagtttaattaatttaaaattctaaattgcctgactacttagaatcttagaaacgccctgctagactgattttattatagaaatgttaacatgttcctcaacattttctcaagaaaattttcagacatatatcaaagttgaaaaaactttgcagtataaccactgctagattctgccatcaacatttgactatacttgtattgccatgtatctgttcatattctctatccctcttttcatccatcgatccatcagattttttttttaaagaacattccaaagtaaattttaggcaatacactgccctaaattcttagcatgggtgtcattaattaaggtttagtattcgtttaaatatctattttgaaagtggtgtatgaagttgataatctgagccaattaacatacttttttttttttcctcctgtggacttttgtcttccagtttctctttttgtgtgtacttagggtgagggaggacaattcctttcaaacacaagtttattttagaattggtcatttttaagtgcttgtcataaattttaaagtttcaatataatttttcttttccccacttctgataatgtatttttgccaaactatgcagcttcttcaaaaaactgtaaattactgattggggtttatgaaatcagcgaatacctcatttcaatctgttgctgcttttctccctcttgtcacttctcctttcactactttcagctgctctaccagaaggtagaggggagtaaagggtcaaacccctatataattagctgttttaaacaactctaggagagcagattaagtagcttagtaagttgaaactattaatttttctaaagaatttgatttgaattccttgagaattgtaattatccacacttcctccagctataattagcagaattaaaaatgattgtactgtacaatgagttgttgaaattgtaagccttagtaaccatctttagctttattgtagtcatgtttagaaaaaattatttttacatatgcctttatttttatgcccactttttgtggataagattctttagataaaatctaaagaattttaagtgactttctccaggtcatgaagattcaatgggtagaattgaatcagaattgaaatgttccagattcatattcttgtgtgtgtttgataaaattcatggcttccaaagtaactgaacacttcctttgggcccttggagggaaaatccatatttttactaattacacttttttttttagacatctggcagttctttgaacttaaacatattctcatggccatagttccaaattaagcccgacgcagttgctaaaaatcttgctgcactgttgaatactaataatgcaacatttattggatgtttttgcattttgatgaccttcatgattcatttataagtctttgtaagtgcttaagtgaccccctcactagtgaaaataataaatgttctatatcatttattattatttgtgtattctctacatgatatatttttttaaggaagagtaactccacatgtcagaatgagtgatattatcctagggcaaagcgcaaatagggcagtttgtttctactctgcaaatatggcatgtataggaacaaaactcttttggagtggctggtcattgttctgccctcttttggtacctgagtacctttctggggttttgtaaatcgtgtgtcatttgtaagaatttcacgttaactctgcgttacttggtgttcacctgtggtatccttgactgaccataatgatttagtttgggtatgatgtgtctgctttgaaatgccttactggagtatgtcagatcctgctttaaagcattccatatatctgctgggacaataagttgcttctccttggaaatatgctctagattcagaagcaaaaccgattttgctttcaccattaaggttgcattttaatgcagttattgttttaaattagagaataaaatgtaaaaccaagggaggctttagaaccctttattgaatggcatggcaaacttttaaaactgcttttgctatttcactagaactatctttgataaaggatatagctaaaaaatgtcagcccaaactgtgtgtaattagggttgtttattaaaattttctctaaatgtcatacagaggcttaagatctgtgtatgctgttgggtcggagtgccagtcactgctttggaagtctgtgttctggggctgcagaatgacaaacgtgtcatgggattaaaaccaatcaactgtgaattgtgaaattgaaactactctttcggttttattttctttagcatattgagtatagaaatctgaaacttatttaaaatttatactgcttttgttgatggctcattttggctgtgtatcctcacttatgtactgatttctgataaaggcttgacattattataacacgcattttgtgttccagtttaataaaacggtttctgagtcttgtctgaaaa

SEQ ID NO: 204593 - DNA, 2944 bp, Homo sapiens
  Payload ID: 20356
  Gene Name: zinc finger, matrin-type 3
  Uniprot ID: Q9HA38
  ENST ID: ENST00000432729
  CDS Start-End: 800-1666
atccactcagccgccttaaccgccaaccagcaggctaagggaggaacagaatgaacaatgtttggatcccaatgactggagatgaaagttgcaaaagctctgcccaggcttctaccaaggattaactttccagggcatctgctgaactgctcttcggggctgtctgctgagattggcggcgggaccctcccgcctctcactcgtgcctttgttccccacgccggcctaaccccgcgcccctgcgctcgcggccagggcacctgacccacgcgccgcccgccggggatgcgggagccgccactgctaccgctgccaccgctgccgggcctgctccgccaagcacatgcgcagtggcgacgccgagccggcgccctcagtctcctcctccaccgcctcccggttccgcagtcacttcctgcagctgtttccctgtgggtcgggttggactgacttttgacagtcagccttcggctgcggagggggctcggcggcggccggcggagaaagttgctccgagaagaggctgggtcgagctgggccgagccgggcgcgcagggcgggcgtcgcgggcgtcccgggcggacgcggcgcggagactgccggcgcgtcccgggggttccggcatttcacgtggaccaggtggatcatctgtgcgtgcagctgccttggccctctcagttgcccccgccccgtgggagtcgggggattccatccttcgtgatggcatccataccgggttgagatttgaagaccttgcttctcatcacccactggattatgccccaggcttccctacccaatgatcctcttgcaacacgccgtgcttcctccacctaagcagccctcaccctcgcctcctatgtcagtggccaccaggtctacaggaaccttgcagcttccaccacagaagccttttgggcaggaggcttccttgcctcttgcaggggaagaagagttatcgaagggaggggagcaagactgtgccctggaggagctatgtaagcccctgtactgcaaactctgcaatgtcaccttgaactctgcacagcaagcccaggctcattatcagggtaaaaatcatggtaagaaactccgaaattactatgcagcaaatagctgtcctcctcctgctagaatgagcaatgtggtcgagcctgcagctactccagttgttccagtccctccgcagatgggctcctttaagccaggaggccgagtgatcctggccacggagaatgattactgtaagctctgtgatgcctccttcagttccccagctgtggctcaggctcactatcaagggaagaatcatgccaagaggctgcggctggcggaagctcagagtaactcattctcggaatcctcagagctgggtcaacggcgggccaggaaagaagggaatgagtttaagatgatgcctaacaggagaaatatgtatacagtacagaataattcaggtccttacttcaatccccgctctcggcagagaattccacgtgatctggccatgtgtgttactccaagtggccagttttactgctcaatgtgtaatgttggagctggcgaagagatggaattccggcagcatttagagagcaagcaacataagagcaaggtgtctgaacagcggtacaggaatgagatggagaatctgggatatgtatagtgattatcatattaagatagagcagcttttcctgcctgttgtttgccttttgtcaacttgccctgctttgtggtctttttgatatgagtacattcctctgcttaatgttaatacatgtaacccacagtggtaccatgagatgtcaaaacctgggggcccgggggcggggcggggggaggtgggtgtgaagaacgtgcttcttaggtcataacgcttttgcagggtcaatggtgttgagccgctcatagcatgtgacctacctaccccatcagaaataactttttatcttgctcaagttctggtcaactagtagcctgacggcttagaactttgactatttaaaagtttcattttcttttgcaattttagttttatgtactgttaaagaattgtactgaattctttttagatcacagtaaaaataggttggcagagatttcagtttcccagggcttaaccagaaccgccacctcaatgcattgtcagtagaatacattattagaaactgttaaggtctttcccgggacatttttttctgccattttcttttgcaattgtagttttatgtactgttaaagaattgtattgaattctttttagatcaaagtaaaaataggtcagcagagatttcagtttcccagggcttaaccagaaccgccacctcaatgcattgtcagtaggatacattattagaaactgttagggtctttcccaggacatttttttttctgtatcatgtctccccatcattgaagcgcaaattttcttgaattcaaatactcccaatgagcttgtatacttccaaacagctaaacttgatttccagttgtggatttcacacatataattgccgccttcttccctcctcttttttcccccctagttgaatcagcttgtctaacaagcccattttcatgccccagctgtgctgtgggttttccaagcctcatatttgaatattcaatgagtttaagatggatatgatttcaaaaaatagggccgggcgcggtggctcacgcctgtaatcccagcactttgggaggccgaagcaggcggatcacgaggtcaggaggtcgagatcatcctggctaacacagtgaaaccccatctctactaaaaatacaaaacattagccgggcgtggtggtgggtgcctgtagtcccagctactctggaggctgaggcaggagaatggcgtgaacccgggaggcggagcttgcagtgagccgagatcgcgccactgcactccagcctgggtgacagagcgagactccgtctc

SEQ ID NO: 204594 - DNA, 743 bp, Homo sapiens
  Payload ID: 20356
  Gene Name: zinc finger, matrin-type 3
  ENST ID: ENST00000414084
  CDS Start-End: 298-743
gctttcaggacgagcccctggagcgccggggactagcggttcctttccgatgctctttccatctgccctccacgtgacagggcttgcgctgcttctatttatcagtttgcttgtttcaggcatttcacgtggaccaggtggatcatctgtgcgtgcagctgccttggccctctcagttgcccccgccccgtgggagtcgggggattccatccttcgtgatggcatccataccgggttgagatttgaagaccttgcttctcatcacccactggattatgccccaggcttccctacccaatgatcctcttgcaacacgccgtgcttcctccacctaagcagccctcaccctcgcctcctatgtcagtggccaccaggtctacaggaaccttgcagcttccaccacagaagccttttgggcaggaggcttccttgcctcttgcaggggaagaagagttatcgaagggaggggagcaagactgtgccctggaggagctatgtaagcccctgtactgcaaactctgcaatgtcaccttgaactctgcacagcaagcccaggctcattatcagggtaaaaatcatggtaagaaactccgaaattactatgcagcaaatagctgtcctcctcctgctagaatgagcaatgtggtcgagcctgcagctactccagttgttccagtccctccgcagatgggctcctttaagccaggaggccgagtgatcctggccacggagaatgattactg

SEQ ID NO: 204595 - DNA, 2466 bp, Homo sapiens
  Payload ID: 20357
  Gene Name: zinc finger, matrin-type 4
  Uniprot ID: Q9H898
  ENST ID: ENST00000297737
  CDS Start-End: 148-837
cagttggtccgagctgccgaaaggtctggtcgcagagacaggaacgtgtaatcctcagcgtgctccagcccacagcttcgctctactgctcggcagggcagctggcctctgggcaccggcggcccctctgcctcgcggaaaagcctgatgaagtcctccgatattgatcaggatttattcacagacagttactgcaaggtgtgcagtgcacagctgatctccgaatcgcagcgtgtggcccactacgagagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgctaggagagaagaccccattaaagaccacagcaacacccctgagcccacttaagcccccacggatggacactgctccggtggtcgcatctccctatcaaagaagagattcagacagatactgtgggctctgtgcagcctggtttaataaccctctgatggcccagcaacattatgatggcaagaaacacaaaaagaatgcggcaagagttgctttgttagaacaactggggacaaccctggatatgggggaactgagaggtctgaggcgcaattacagatgtaccatctgcagtgtctccctaaactcaatagaacagtatcatgcccatctgaaaggatctaaacaccagaccaacctgaagaataagtagtgaaagcatcaatcaagacataagaacaaaacattagcatttctctgccgtggagaattgcttatcaaccaccagaggaggcttctttcttgaacaataaacatttcttataaggattcacagattcacatacgactgatcttgatttttggaaatgaatgaggtttcttttttctttttcctttttttaattttggggtaagttatgatatttggatggatttttaaattctttcctgataacatatttagcacatgttctaaattataatcctatagcaaacagttggagcattattcaaactgaaagtggaaaaatttaaatttccaatttattctagatttcctcagagcataattattctgttaaatcctcaatgagtgtgatgtaaaccacctctatccagaaatatacattcttttctcatcatgttggacacagttgagggtgacatgcacagaactggaacagatcactattagtggaaaataccaaatggacaaataaataccagtcgttttctccgttctccaagcacaggagccaggtttaccatctgaacaatgaagacgaagggagtaaataaaggaagaattctcatcttttttcctgatcattcaaagaacagtttctcaaggttaagccaagtcctccttgcaagttgccaaataatagcttaggaaaagaattagtctgcctgcatgatgatcttcttaggcaaaaacgtcttcacagcccttgaccttggtgaatttttttccccaaaagcatccaaaagaagaattataaaccccagaatgagatggaaataaacaagtatttttttttatgatgtttggcctgaactgtgggctttaattgggggatactgatcgtttggaaagaagtgagaaaattctgaagaaatggcggccttgggctaggcggggtcccctatttcttctgtttctcactgaagtcctactgctgagccaagactcagtcactctggaaagagcatgaccgataaagaaaacagttcctttctgatggggagcgtctgagtgcagatcatgaggctctttctctaggtttaattcttttccatggtgaccggacttggtgtcttgtagcctggttacgaagtgggacgttgagcttctactgacgatgccctgcatggaccagctgggatctggctggggctgccctgtgtccctaacgaccataggcaatccatcttcttgtgtcagcaatttctggacacccactgttttccaccaagagctgaggtggcaacaactcagtgagcaataaacaaaatgacacagaaatgcacagtgttgttatgaaggagcctgtttacctgtgttcaaaatctggcaccattcccttgagcagggcccgctcaggagggaccaggtctgccagtttctgtgcctgcagagagacgaagccccacgagccacaccctactctacaagaggaaagggggttggatgggaagaatctattttgctgttttggaaagcacacagccgacctacaaacctcctgtgatggtgtttcttcggatgtgtaaaataaggctttatttgtcaattccgctgtaaaataagcattgtccgagtaaaaacagcagcaacaac

SEQ ID NO: 204596 - DNA, 2250 bp, Homo sapiens
  Payload ID: 20357
  Gene Name: zinc finger, matrin-type 4
  Uniprot ID: Q9H898
  ENST ID: ENST00000315769
  CDS Start-End: 156-617
cgctagcacagttggtccgagctgccgaaaggtctggtcgcagagacaggaacgtgtaatcctcagcgtgctccagcccacagcttcgctctactgctcggcagggcagctggcctctgggcaccggcggcccctctgcctcgcggaaaagcctgatgaagtcctccgatattgatcaggatttattcacagacagttactgcaaggtgtgcagtgcacagctgatctccgaatcgcagcgtgtggcccactacgagagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgctaggagagaagaccccattaaagaccacaggtctgaggcgcaattacagatgtaccatctgcagtgtctccctaaactcaatagaacagtatcatgcccatctgaaaggatctaaacaccagaccaacctgaagaataagtagtgaaagcatcaatcaagacataagaacaaaacattagcatttctctgccgtggagaattgcttatcaaccaccagaggaggcttctttcttgaacaataaacatttcttataaggattcacagattcacatacgactgatcttgatttttggaaatgaatgaggtttcttttttctttttcctttttttaattttggggtaagttatgatatttggatggatttttaaattctttcctgataacatatttagcacatgttctaaattataatcctatagcaaacagttggagcattattcaaactgaaagtggaaaaatttaaatttccaatttattctagatttcctcagagcataattattctgttaaatcctcaatgagtgtgatgtaaaccacctctatccagaaatatacattcttttctcatcatgttggacacagttgagggtgacatgcacagaactggaacagatcactattagtggaaaataccaaatggacaaataaataccagtcgttttctccgttctccaagcacaggagccaggtttaccatctgaacaatgaagacgaagggagtaaataaaggaagaattctcatcttttttcctgatcattcaaagaacagtttctcaaggttaagccaagtcctccttgcaagttgccaaataatagcttaggaaaagaattagtctgcctgcatgatgatcttcttaggcaaaaacgtcttcacagcccttgaccttggtgaatttttttccccaaaagcatccaaaagaagaattataaaccccagaatgagatggaaataaacaagtatttttttttatgatgtttggcctgaactgtgggctttaattgggggatactgatcgtttggaaagaagtgagaaaattctgaagaaatggcggccttgggctaggcggggtcccctatttcttctgtttctcactgaagtcctactgctgagccaagactcagtcactctggaaagagcatgaccgataaagaaaacagttcctttctgatggggagcgtctgagtgcagatcatgaggctctttctctaggtttaattcttttccatggtgaccggacttggtgtcttgtagcctggttacgaagtgggacgttgagcttctactgacgatgccctgcatggaccagctgggatctggctggggctgccctgtgtccctaacgaccataggcaatccatcttcttgtgtcagcaatttctggacacccactgttttccaccaagagctgaggtggcaacaactcagtgagcaataaacaaaatgacacagaaatgcacagtgttgttatgaaggagcctgtttacctgtgttcaaaatctggcaccattcccttgagcagggcccgctcaggagggaccaggtctgccagtttctgtgcctgcagagagacgaagccccacgagccacaccctactctacaagaggaaagggggttggatgggaagaatctattttgctgttttggaaagcacacagccgacctacaaacctcctgtgatggtgtttcttcggatgtgtaaaataaggctttatttgtcaattccgctgtaaaataagcattgtccgagtaaaaacagcagcaacaacaaaa

SEQ ID NO: 204597 - DNA, 515 bp, Homo sapiens
  Payload ID: 20357
  Gene Name: zinc finger, matrin-type 4
  ENST ID: ENST00000523542
  CDS Start-End: 133-273
gccgaaaggtctggtcgcagagacaggaacgtgtaatcctcagcgtgctccagcccacagcttcgctctactgctcggcagggcagctggcctctgggcaccggcggcccctctgcctcgcggaaaagcctgatgaagtcctccgatattgatcaggatttattcacagacagttactgcaaggtgtgcagtgcacagctgatctccgaatcgcagcgtgtggcccactacgagtgtggtgcagttcctctgggaatgagcaatgtaacttaaaactagctgtgtcaataagtcaagagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgct

SEQ ID NO: 204598 - DNA, 690 bp, Homo sapiens
  Payload ID: 20357
  Gene Name: zinc finger, matrin-type 4
  ENST ID: ENST00000519406
  CDS Start-End: 56-690
ctttggaccgttcacaggctaattgggaaaagtggacaggcctgcctgaagcctgatgaagtcctccgatattgatcaggatttattcacagacagttactgcaaggtgtgcagtgcacagctgatctccgaatcgcagcgtgtggcccactacgagagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgctaggagagaagaccccattaaagaccacagcaacacccctgagcccacttaagcccccacggatggacactgctccggtggtcgcatctccctatcaaagaagagattcagacagatactgtgggctctgtgcagcctggtttaataaccctctgatggcccagcaacattatgatggcaagaaacacaaaaagaatgcggcaagagttgctttgttagaacaactggggacaaccctggatatgggggaactgagaggtctgaggcgcaattacagatgtaccatctgcagtgtctccctaaactcaatagaaca

SEQ ID NO: 204599 - DNA, 473 bp, Homo sapiens
  Payload ID: 20357
  Gene Name: zinc finger, matrin-type 4
  ENST ID: ENST00000522623
  CDS Start-End: 130-270
gaaaggtctggtcgcagagacaggaacgtgtaatcctcagcgtgctccagcccacagcttcgctctactgctcggcagggcagctggcctctgggcaccggcggcccctctgcctcgcggaaaagcctgatgaagtcctccgatattgatcaggatttattcacagacagttactgcaaggtgtgcagtgcacagctgatctccgaatcgcagcgtgtggcccactacgagtgtggtgcagttcctctgggaatgagcaatgtaacttaaaactagctgtgtcaataagtcaagggtccagaattcttgaggaaggggaatttcattagacatactaagccaaaagaagatgtcacactgaagaaggtggctgtgtgaattctgacccagtcgaaaacatgcaagcaaagtccgactgtattacatgcttcaccccagggatggagggtgtcctgccaagaggctccggtcag

SEQ ID NO: 204600 - DNA, 564 bp, Homo sapiens
  Payload ID: 20357
  Gene Name: zinc finger, matrin-type 4
  ENST ID: ENST00000523188
  CDS Start-End: 147-332
agttggtccgagctgccgaaaggtctggtcgcagagacaggaacgtgtaatcctcagcgtgctccagcccacagcttcgctctactgctcggcagggcagctggcctctgggcaccggcggcccctctgcctcgcggaaaagcctgatgaagtcctccgatattgatcaggatttattcacagacagttactgcaaggtgtgcagtgcacagctgatctccgaatcgcagcgtgtggcccactacgagggtccagaattcttgaggaaggggaatttcattagacatactaagccaaaagaagatgtcacactgaagaaggtggctgtgtgaattctgacccagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgctagga

SEQ ID NO: 204601 - DNA, 899 bp, Homo sapiens
  Payload ID: 20358
  Gene Name: zinc finger, matrin-type 5
  Uniprot ID: Q9UDW3
  ENST ID: ENST00000344318
  CDS Start-End: 118-630
accggggagccaggtaccttccgcgagacgtcgaggggcgagtcctagtctcttttctccgcactggaagacttgaacacttccttctctgcagcaaagcacctgctctgagtggccatggggaagcgatacttctgtgactactgcgaccgctccttccaggacaacctccacaaccgcaagaagcacctgaacgggctgcagcacctcaaggccaagaaggtctggtacgacatgttccgagatgcagctgccatcttgctggatgagcagaacaagcggccctgcaggaagtttctactgacaggccagtgcgactttggctccaactgcagattttcccacatgtcagagcgagacctgcaggagctgagcatccaggtggaggaggagaggcgagccagggagtggctactagatgctcctgagctccccgagggccatctggaggactggctggagaagagagccaagcggctgagctcagccccaagtagcagggctgaacccatcagaaccactgtcttccagtaccccgtgggctggccaccagttcaggagctgcctccatccctgcgggcacccccacctggggggtggcctctgcagcccagagtccagtggggctgagccccttgcccccgactgacccccacgtggtcacttttctcatcagtcacaataggaagccaagcccggttcctgctacgccccatggaggctccgagaccatctgcccagcctcactgaggctcaggacacggccacaccaagtgcagccctcgtcctgggtctgcaccgggcagctctcccctcactctcctccacctgcccccctgcttcttaagaagatgggggagaaaacttccaaatgtttataaagaaagtctgtcaccaca

SEQ ID NO: 204602 - DNA, 7546 bp, Homo sapiens
  Payload ID: 20359
  Gene Name: zinc finger, MIZ-type containing 1
  Uniprot ID: Q9ULJ6
  ENST ID: ENST00000334512
  CDS Start-End: 573-3776
cgggcgccggggagagcgggcggccgggcggcaggcgggcgagcagcgatcgggcggccgagcgagcgagcaacgccggcgcagcgcggtgaccccagccccagccggcgcggagcaggagccggagccgagcggatctcggcgccctcgctgcgctcctcccggcccgagcctgccctacccggcggtggcggcggcgcgtcctccagcggcggcagcggcgctcgcagcgcccggactcacggcagctgtgttctgatttcgtactactgctggggctgccacctcctcctccagacgctctcagcagacttgagtcctggtccttctgcagaggcctgagcaggaggaagaggaggaggcccgttggcgtcggaccaatgctgcaaggggtgtgaggagaggagccgctgtttttcactgagctgccataccccgaaagcaggatggagctggagtgaggtggaggggccgcaagctgctgaccggcgtgtggaacactggtggtttgcagatcactgaggctggacaacgttcatggctctcgggtagaacctagtgaaacggccagaatgaattctatggacaggcacatccagcagaccaatgaccgactgcagtgcatcaagcagcacttacagaatcctgccaacttccacaatgccgccacggagctgctggactggtgcggagacccacgggccttccagcggcccttcgagcagagcctgatgggctgtttgacggtggtcagtcgggtggcagcccagcaaggctttgacctggacctcggctacagactgctggctgtgtgtgctgcaaaccgagacaagttcaccccgaagtctgccgccttgttgtcctcctggtgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggcagcagaacaccaaccagcctcccggctccctttccgtggtcaccacggtttggggagtaaccaacacatcccagagccaggtccttgggaaccctatggccaatgccaacaaccccatgaatccaggcggcaaccccatggcgtcgggcatgaccaccagcaacccaggcctcaactccccacagtttgcggggcagcagcagcagttctcagccaaggctggccccgctcagccctacatccagcagagcatgtatggccggcccaactaccccggcagcgggggctttggggccagttaccctgggggtcctaacgcccccgcaggcatgggcatccctccgcacaccaggccgcctgctgacttcactcagcccgcggcagccgctgcagcagcggcagtggcagcagcagcagccacagctacagccacagccacggccactgtggcagccctgcaggagacacagaacaaggatataaaccagtatggaccgatgggtcccacccaggcgtataacagccaattcatgaaccagcccgggccgcgggggcctgcctccatggggggcagcatgaaccccgcgagcatggcggctggcatgacgccctcggggatgagcggccctcccatgggcatgaaccagccccggccgcccggcatcagcccctttggcacacacgggcagcggatgccccagcagacctacccgggcccccggccccagtcccttcctattcagaacataaagaggccataccctggagagcccaactatggaaaccagcaatatggaccaaacagccagttccccacccagccaggccagtacccagcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccacccccagccaaccacaatgacgagctgcggctcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaataaaaccgctctgctggagggcctggaggtggatcagtacatgtggggaatcctgaatgccatccaacactccgagtttgaagaggtcaccatcgatcccacgtgcagctggcggccggtgcccatcaagtcggacttacacatcaaggacgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactatgccacacgctggcagctctgaccagccccacccctccatacaacaaggtttgcacgtaccacaccccagcagccagtcagggcctccattacatcacagtggggctcctcctcctcctccttcccagcctccccggcagccgccacaggccgctcccagcagccatccacacagcgacctgacctttaacccctcctcagccttagagggtcaggccggagcgcagggagcgtccgacatgccggagccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctacccaacacacttttccacctgggagcctgtgccctcagaccgccccgcaccagagccacgggctgtggggcggggagccctcccccgctgcagccctctcagaacagaggggtagggagggtgcaccagtgcaccaggaaggctgtgtgggtctggagcccacgtcccacctccacacccttggcttgggcccatgcccagcgcaggcctgaagaccaccctcccgagaggaaccagcccggtaagagggcacacgctgatgcggcttcccggtccctccgcgtgtgccgattccagatgaccttccagtgtccccaaggttcttccatcttctagactgtaaccctgcctccctgcttcctggtccagagcctccctccagtgactgtggagcctgagaaggcccccgggccccagcatgggccccgagccttggaggagcactggcagttggtggcagtgagaccagcccacccaccaccacccaccacagaaaagcacaaacctctgggaaagacaacgtctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatgggggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagctctcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtatattaggtgttcatgtggttattttgtatttaaagatcaaattatttgactattgctagacatttctatactctgttgtaacactgaggtatctcatttgcccatgttaatttttttctaaataaattgacaaaaacaaa

SEQ ID NO: 204603 - DNA, 6686 bp, Homo sapiens
  Payload ID: 20359
  Gene Name: zinc finger, MIZ-type containing 1
  ENST ID: ENST00000446377
  CDS Start-End: 1-2907
atgaggttgctgaggcatacagagagtgagcagtggtttcatcgcttccctctgtgtccttctctcactttctgggccccagtggccatgtggccacagacacactgtgtaggtggtcggtcatcaggcttaacgaaatggacatattcattttcagcatcactccaagatgggtcgttcccctatgactctgtcccttggcagcagaacaccaaccagcctcccggctccctttccgtggtcaccacggtttggggagtaaccaacacatcccagagccaggctgacgttctcatcccccacgccacctgccgcccaggcccgctccttatcagtccttgggaaccctatggccaatgccaacaaccccatgaatccaggcggcaaccccatggcgtcgggcatgaccaccagcaacccaggcctcaactccccacagtttgcggggcagcagcagcagttctcagccaaggctggccccgctcagccctacatccagcagagcatgtatggccggcccaactaccccggcagcgggggctttggggccagcccgcggcagccgctgcagcagcggcagtggcagcagcagcagccacagctacagccacagccacggccactgtggcagccctgcaggagacacagaacaaggatataaaccagtatggaccggccccagtgctgctccctgaccttctgaaggatgggttaggggatgaggagaggggagcccccataggaatgcagaacaggaggaaccccgcgagcatggcggctggcatgacgccctcggggatgagcggccctcccatgggcatgaaccagccccggccgcccggcatcagcccctttggcacacacgggcagcggatgccccagcagacctacccgggcccccggccccagtcccttcctattcagaacataaagaggccataccctggagagcccaactatggaaaccagcaatatggaccaaacagccagttccccacccagccaggccagtacccagcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccacccccagaccacaatgacgagctgcggctcacattccctgtgcgggatggcgtggtgctggagcccttccgcctggagcacaacctggcggtcagcaaccatgtgttccacctgcggcccacggtccaccagacgctgatgtggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaaaaccgctctgctggagggcctggaggtggatcagtacatgtggggaatcctgaatgccatccaacacgagtttgaagaggtcaccatcgatcccacgtgcagctggcggccggtgcccatcaagtcggacttacacatcaaggacgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaagacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactatgccacacgctggcagctctgaccagccccacccctccatacaacaaggtttgcacgtaccacaccccagcagccagtcagggcctccattacatcacagtggggctcctcctcctcctccttcccagcctccccggcagccgccacaggccgctcccagcagccatccacacagcgacctgacctttaacccctcctcagccttagagggtcaggccggagcgcagggagcgtccgacatgccggagccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctacccaacacacttttccacctgggagcctgtgccctcagaccgccccgcaccagagccacgggctgtggggcggggagccctcccccgctgcagccctctcagaacagaggggtagggagggtgcaccagtgcaccaggaaggctgtgtgggtctggagcccacgtcccacctccacacccttggcttgggcccatgcccagcgcaggcctgaagaccaccctcccgagaggaaccagcccggtaagagggcacacgctgatgcggcttcccggtccctccgcgtgtgccgattccagatgaccttccagtgtccccaaggttcttccatcttctagactgtaaccctgcctccctgcttcctggtccagagcctccctccagtgactgtggagcctgagaaggcccccgggccccagcatgggccccgagccttggaggagcactggcagttggtggcagtgagaccagcccacccaccaccacccaccacagaaaagcacaaacctctgggaaagacaacgtctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatgggggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagctctcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtatattaggtgttcatgtggttattttgtatttaaagatcaaattatttgactattgctagacatttctatactctgttgtaacactgaggtatctcatttgcccatgttaatttttttctaaataaattgacaaaaacaaaggtttggcg

SEQ ID NO: 204604 - DNA, 2196 bp, Homo sapiens
  Payload ID: 20359
  Gene Name: zinc finger, MIZ-type containing 1
  ENST ID: ENST00000611351
  CDS Start-End: 39-701
ttcatggctctcgggtagaacctagtgaaacggccagaatgaattctatggacaggcacatccagcagaccaatgaccgactgcagtgcatcaagcagcacttacagaatcctgccaacttccacaatgccgccacggagctgctggactggtgcggagacccacgggccttccagcggcccttcgagcagagcctgatgggctgtttgacggtggtcagtcgggtggcagcccagcaaggctttgacctggacctcggctacagactgctggctgtgtgtgctgcaaaccgagacaagttcaccccgaagtctgccgccttgttgtcctcctggtgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagctctcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgact

SEQ ID NO: 204605 - DNA, 3643 bp, Homo sapiens
  Payload ID: 20360
  Gene Name: zinc finger, MIZ-type containing 2
  Uniprot ID: Q8NF64
  ENST ID: ENST00000265346
  CDS Start-End: 46-2730
cagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagcc

SEQ ID NO: 204606 - DNA, 5144 bp, Homo sapiens
  Payload ID: 20360
  Gene Name: zinc finger, MIZ-type containing 2
  Uniprot ID: Q8NF64
  ENST ID: ENST00000309315
  CDS Start-End: 124-2886
cgcatggagcggcgcgggccgggggccgccacggcgaggggccgggccaggccgggcggagccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcccacagagcagttcaacgggcagggcgccagcttcaacgggggcagcgtcagctacagccaacctggcctgagtgggcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcgagcagggcgcctgggctgttgtgtctcctgtctgtgccgatctctattaaaggactccctcttggtgggcctggccgagtccctcctttgtgctcccagggactattttctcctcgtaagccagcgacctgcctaaagcttgggctgtgcctgcaaagcttgtgcaggacctgggggccaggtcgaccttcaagtggcttttggggccccaggttgagctctggatgtttcaagccaaggctcggctattcccgccccatagtaaatttccttttccctggaattttccaagttggcttcagctgaagagctgttttgtgaagcatcccaggcttgcccaggagagacatttgccactatgtcaccttatctgggcttgccctggggcactgagacagttgtttggcagccccagcccagccaggggctcatccttctcagctcttgtccctgggaggcctctgcttgtcacttcccagagattgcagaggtgtgtcctgcctaccatctgcctgtccagcttggtgggggtccgggtcaccatttcctccagtcctgggccccatccttgagggccttcccagccagccagcaggagaggcaagaactgggggaacacaggaacctaggggaggaggggagcgctgggcatcctcaggctggcggccaaggcctgcccctggaggcactagaggagggcatctgtctgtgggagcccagaggctgcagggaggaggaggagggaggtatctggtgtgagcgttgcccctgcgacatttgggaccacacaggtgggcttccttattccctgacaaagcctctgtttccagctcttccgccctctctggatgagggaacagaagtggaggaaacaaaagaagcagcagcacgcacagtcctgtcgctgggtgcggagacagcctggcaaagtcccactcagccatggcctgatgcaggccccaggccctcctttcttgggtgtcaaatgactgtgtcctggacatctgatgcaccacctgccctgcctgttgcaaacgtgatgctcccggatggagtggagaaactaggagactgggacaagcaaaaggctgcaaacaacccagaagcccatcctcagaagactggagaaatgattgaggaatgcatgggcaccgtggccctgtgctccatcacaaacacctctcagaaacaacgtgggatgaaaaagcaagacagttcatacagtatgatgccatttttataaagctcaaaaccaaa

SEQ ID NO: 204607 - DNA, 3800 bp, Homo sapiens
  Payload ID: 20360
  Gene Name: zinc finger, MIZ-type containing 2
  ENST ID: ENST00000433667
  CDS Start-End: 63-2729
ccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcccacagagcagttcaacgggcagggcgccagcttcaacgggggcagcgtcagctacagccaacctggcctgagtgggcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcgagcagggcgcctgggctgttgtgtctcctgtctgtgccgatctctattaaaggactccctcttggtgggc

SEQ ID NO: 204608 - DNA, 616 bp, Homo sapiens
  Payload ID: 20360
  Gene Name: zinc finger, MIZ-type containing 2
  ENST ID: ENST00000416856
  CDS Start-End: 93-281
cggcgaggggccgggccaggccgggcggagccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcg

SEQ ID NO: 204609 - DNA, 3773 bp, Homo sapiens
  Payload ID: 20360
  Gene Name: zinc finger, MIZ-type containing 2
  Uniprot ID: Q8NF64
  ENST ID: ENST00000413916
  CDS Start-End: 114-2702
gactgcgagcaggaagagcgcagtggctctgccgacgccgcgttcagaaagccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcgagcagggcgcctgggctgttgtgtctcctgtctgtgccgatctctattaaaggactccctcttggtgggc

SEQ ID NO: 204610 - DNA, 5089 bp, Homo sapiens
  Payload ID: 20360
  Gene Name: zinc finger, MIZ-type containing 2
  Uniprot ID: Q8NF64
  ENST ID: ENST00000441627
  CDS Start-End: 72-2834
gtcgggcagccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcccacagagcagttcaacgggcagggcgccagcttcaacgggggcagcgtcagctacagccaacctggcctgagtgggcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcgagcagggcgcctgggctgttgtgtctcctgtctgtgccgatctctattaaaggactccctcttggtgggcctggccgagtccctcctttgtgctcccagggactattttctcctcgtaagccagcgacctgcctaaagcttgggctgtgcctgcaaagcttgtgcaggacctgggggccaggtcgaccttcaagtggcttttggggccccaggttgagctctggatgtttcaagccaaggctcggctattcccgccccatagtaaatttccttttccctggaattttccaagttggcttcagctgaagagctgttttgtgaagcatcccaggcttgcccaggagagacatttgccactatgtcaccttatctgggcttgccctggggcactgagacagttgtttggcagccccagcccagccaggggctcatccttctcagctcttgtccctgggaggcctctgcttgtcacttcccagagattgcagaggtgtgtcctgcctaccatctgcctgtccagcttggtgggggtccgggtcaccatttcctccagtcctgggccccatccttgagggccttcccagccagccagcaggagaggcaagaactgggggaacacaggaacctaggggaggaggggagcgctgggcatcctcaggctggcggccaaggcctgcccctggaggcactagaggagggcatctgtctgtgggagcccagaggctgcagggaggaggaggagggaggtatctggtgtgagcgttgcccctgcgacatttgggaccacacaggtgggcttccttattccctgacaaagcctctgtttccagctcttccgccctctctggatgagggaacagaagtggaggaaacaaaagaagcagcagcacgcacagtcctgtcgctgggtgcggagacagcctggcaaagtcccactcagccatggcctgatgcaggccccaggccctcctttcttgggtgtcaaatgactgtgtcctggacatctgatgcaccacctgccctgcctgttgcaaacgtgatgctcccggatggagtggagaaactaggagactgggacaagcaaaaggctgcaaacaacccagaagcccatcctcagaagactggagaaatgattgaggaatgcatgggcaccgtggccctgtgctccatcacaaacacctctcagaaacaacgtgggatgaaaaagcaagacagttcatacagtatgatgccatttttataaagctcaaaacc

SEQ ID NO: 204611 - DNA, 747 bp, Homo sapiens
  Payload ID: 20360
  Gene Name: zinc finger, MIZ-type containing 2
  ENST ID: ENST00000457123
  CDS Start-End: 479-747
cgggcggcggcgcgatggcgcgggtggcggcggccccggggcggcgggcggcgcggagggcgggctgagcgcatggagcggcgcgggccgggggccgccacggcgaggggccgggccaggccgggcggagatttcacagggacacacacggaacatgtgacttggtctgagaccgtggtgattacggataggatggacacagactcaccaccaagttctggcaagctagaaccagagggcatcccttgatgcttagtgtggaaacaggagaagtgaaggaatcttaacttccagaggggcacagggtcaaggataccagacctggagactggaagtcttttcagagagactgtcctcagagaggagaccagaggcatgagttcgggtcggcaggaaatccccctgtgcagtgaagaccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctggg

SEQ ID NO: 204612 - DNA, 2772 bp, Homo sapiens
  Payload ID: 20360
  Gene Name: zinc finger, MIZ-type containing 2
  ENST ID: ENST00000615423
  CDS Start-End: 1-2772
atgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcccacagagcagttcaacgggcagggcgccagcttcaacgggggcagcgtcagctacagccaacctggcctgagtgggcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgcgccaggccgcaacaccatccatcaccgtcaccgcctgctgctgcgtgcgtgtcctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactga

SEQ ID NO: 204613 - DNA, 4175 bp, Homo sapiens
  Payload ID: 20361
  Gene Name: zinc finger, MYM-type 1
  Uniprot ID: Q5SVZ6
  ENST ID: ENST00000359858
  CDS Start-End: 151-3579
gggcggggtcggcggggccgtttcgcttcgaagattgtttcagaagcgttgggcggggcgtccctgagagaaattagaatctggaaactgttcttcaggaagaaacccattagtttggaactggagaattcctttgcatcagatactaaaatgaaagaaccacttttaggtggtgagtgtgacaaggcagtggcatcacagctggggctgctagatgaaattaagacagaacccgacaatgctcaagagtattgtcataggcaacagtccagaactcaggagaatgaactgaaaataaatgctgtgttttcagagagtgcttcacagttgactgcaggcattcagctttctctggcatcatctggcgtgaataaaatgcttccttcagtttcaaccacagctattcaggtttcctgtgctggttgtaaaaaaattctccagaaggggcaaactgcttatcagaggaaaggatctgctcaacttttctgctccataccatgcatcactgaatacatttcatctgccagttcaccagttccttctaagagaacttgttcaaactgctcaaaagacattttaaatccaaaggatgtgattagtgtccagctggaagacactacctcttgcaaaactttttgcagcctatcttgtctttcatcatatgaagaaaaaagaaaaccatttgttaccatatgtactaatagcattttgaccaagtgcagcatgtgccagaagactgctattattcagtatgaagtaaaataccaaaatgtgaaacataatctttgcagtaatgcctgcctttcaaagtttcactctgctaacaacttcatcatgaactgctgtgagaactgtggcacttactgttacaccagctctagtctgtcccacatacttcagatggaaggacagtctcattactttaatagttcaaagagtattacagcatataagcagaaacctgccaaaccacttatatctgttccttgcaaaccattgaagccctcagatgaaatgattgagactacgagtgatttggggaagacagagcttttctgctctattaattgtttctctgcatacagtaaagctaagatggaatcttcttcagtaagtgttgtttctgtggtgcatgatacttcaacagagcttctttctccaaagaaagatacgactccagttataagcaatatagtgtcattggcagacaccgatgttgccttgcccatcatgaacactgatgtcttacaagatacagtttcttcagtaacagcaacagcagatgtcattgtggatctttctaagagttcacctagtgaacccagtaatgctgttgctagtagtagtacggaacagccaagcgtttcaccatcttcatcagtattcagtcagcatgcaattggttccagtacagaagtacaaaaagacaatatgaaatctatgaaaataagtgatgaactatgtcacccaaaatgtacatccaaagtacaaaaagttaaaggtaaatcacgaagtattaaaaaatcttgttgtgcagattttgagtgtttggaaaacagtaaaaaagatgtggcattctgttattcatgccagttgttctgccaaaaatattttagctgtggaagagagtcatttgcaacccacggaacttctaattggaaaaaaaccctggaaaaattcagaaagcatgaaaaaagtgaaatgcatttgaagtcattggaattttggagagaataccaattttgtgatggagctgtcagtgacgatttatctattcattcgaaacagattgagggaaataaaaagtacctaaagcttataattgaaaatattttatttcttggaaagcagtgtttacccttaagaggaaacgaccagtcagtttcatctgtgaataaaggcaattttttagaattgttagaaatgagagcaaaagataaaggagaagaaacatttcgacttatgaattcacaagttgacttctataacagtacacaaattcaaagtgatattatcgaaataataaagactgaaatgttgcaggatattgtgaatgagatcaatgactcctcagcattttcaatcatatgtgatgagacaatcaatagtgccatgaaagaacagctttcaatttgtgtaagatacccacaaaaatcatcaaaggctatcttaattaaggaaagattcttgggttttgttgatactgaggagatgactgggacccacttacataggactatcaaaacttatctgcagcaaattggagttgatatggataaaatacatggccaggcctatgatagcaccactaatttgaagataaaatttaataaaatagcagcagaattcaagaaagaagaaccaagagctttatacatacattgttatgcacactttttggatttatcaataattaggttttgtaaagaagtaaaagaactccgaagtgctctaaaaactctcagttctttgttcaacactatttgtatgtctggggaaatgttggcaaattttcgaaacatttataggctaagtcaaaacaaaacatgcaagaaacatatatcacaatcatgttggacagtccatgatcgtacattactatctgtgattgacagtcttccagagattattgaaacattggaagttatagcaagccattcttcaaatacaagtttcgccgatgaattgagtcatttgctgacattggtttccaaatttgaatttgtcttttgtttgaaattcctgtatcgagtgctgagtgttacaggaattctttccaaagagcttcaaaataaaaccatagacattttttctttgtcttcaaaaatagaagcaattttggaatgtttatcatctgaaagaaatgacgtatactttaaaacaatctgggatggaacagaggaaatatgtcaaaaaataacctgtaaaggttttaaagttgaaaaaccttctcttcagaaaagaagaaaaattcagaaatcagtagatcttggcaattcagataatatgttttttcctacttcaacagaagaacaatataaaattaatatctattaccaaggattagatactatattacaaaatttaaagttatgtttttcggagtttgattattgcaaaataaagcaaatttcagaactgttatttaaatggaatgaaccattaaatgaaacaacagcaaaacatgttcaggaattttataaacttgatgaggacattatcccagaacttagattttatcgacattatgcaaagcttaactttgtcatagatgatagttgcataaacttcgtcagtctcggctgtttgtttattcagcatggtcttcacagtaatattccttgtctctcaaagctattatatattgctttgtcttggccaattacttcagcaagtactgagaactcattttctaccctgcctcgtcttaagacatatttatgtaataccatgggacaagagaagcttactggcccagccctaatggctgttgagcaggagttggtaaataaactaatggagcctgaaagactcaatgaaattgtggaaaagtttatcagtcagatgaaagaaatataatacatgctcatttgaacttacctaaaagacttgtatttccattgggatgttttcatttcaaaattgttcaaaattcaaaagacacagaacgataaacagtgaagtctccttccctcctttagaactcattttctcttcccaaaaagtgttatcttttccttaaatatccctctagaggtatttttcctaagtggtattgtacggtgtatactgttcttcagcttgtcttctctgtgtaacatatttttgagattgtcccatgtcgttacatgaagagtttcttgattcttggtctataattgcagatgttattgtatgaatgtaccataatatatttgagcagtccctgctgacatttttttcctaaccttttgctattataaataatgattcattttataaccttttatataggtcacattgcacatgagtgagtttactgtaagctggaaatctaaagttagaattactaggttaagatatgtgcatttttacttttgatagatattggcaagttgccatctataaggattgtgccagtttacagtcccacccacaatgcatgagagtgcctattaaatctttgtaagtgttat

SEQ ID NO: 204614 - DNA, 4203 bp, Homo sapiens
  Payload ID: 20361
  Gene Name: zinc finger, MYM-type 1
  Uniprot ID: Q5SVZ6
  ENST ID: ENST00000373330
  CDS Start-End: 175-3603
gcttcgaagattgtttcagaagcgttgggcggggcgtccctgagagaaattagttcaagcgattctcgtgcctcagcctcccgagtagctgggattacaggaatctggaaactgttcttcaggaagaaacccattagtttggaactggagaattcctttgcatcagatactaaaatgaaagaaccacttttaggtggtgagtgtgacaaggcagtggcatcacagctggggctgctagatgaaattaagacagaacccgacaatgctcaagagtattgtcataggcaacagtccagaactcaggagaatgaactgaaaataaatgctgtgttttcagagagtgcttcacagttgactgcaggcattcagctttctctggcatcatctggcgtgaataaaatgcttccttcagtttcaaccacagctattcaggtttcctgtgctggttgtaaaaaaattctccagaaggggcaaactgcttatcagaggaaaggatctgctcaacttttctgctccataccatgcatcactgaatacatttcatctgccagttcaccagttccttctaagagaacttgttcaaactgctcaaaagacattttaaatccaaaggatgtgattagtgtccagctggaagacactacctcttgcaaaactttttgcagcctatcttgtctttcatcatatgaagaaaaaagaaaaccatttgttaccatatgtactaatagcattttgaccaagtgcagcatgtgccagaagactgctattattcagtatgaagtaaaataccaaaatgtgaaacataatctttgcagtaatgcctgcctttcaaagtttcactctgctaacaacttcatcatgaactgctgtgagaactgtggcacttactgttacaccagctctagtctgtcccacatacttcagatggaaggacagtctcattactttaatagttcaaagagtattacagcatataagcagaaacctgccaaaccacttatatctgttccttgcaaaccattgaagccctcagatgaaatgattgagactacgagtgatttggggaagacagagcttttctgctctattaattgtttctctgcatacagtaaagctaagatggaatcttcttcagtaagtgttgtttctgtggtgcatgatacttcaacagagcttctttctccaaagaaagatacgactccagttataagcaatatagtgtcattggcagacaccgatgttgccttgcccatcatgaacactgatgtcttacaagatacagtttcttcagtaacagcaacagcagatgtcattgtggatctttctaagagttcacctagtgaacccagtaatgctgttgctagtagtagtacggaacagccaagcgtttcaccatcttcatcagtattcagtcagcatgcaattggttccagtacagaagtacaaaaagacaatatgaaatctatgaaaataagtgatgaactatgtcacccaaaatgtacatccaaagtacaaaaagttaaaggtaaatcacgaagtattaaaaaatcttgttgtgcagattttgagtgtttggaaaacagtaaaaaagatgtggcattctgttattcatgccagttgttctgccaaaaatattttagctgtggaagagagtcatttgcaacccacggaacttctaattggaaaaaaaccctggaaaaattcagaaagcatgaaaaaagtgaaatgcatttgaagtcattggaattttggagagaataccaattttgtgatggagctgtcagtgacgatttatctattcattcgaaacagattgagggaaataaaaagtacctaaagcttataattgaaaatattttatttcttggaaagcagtgtttacccttaagaggaaacgaccagtcagtttcatctgtgaataaaggcaattttttagaattgttagaaatgagagcaaaagataaaggagaagaaacatttcgacttatgaattcacaagttgacttctataacagtacacaaattcaaagtgatattatcgaaataataaagactgaaatgttgcaggatattgtgaatgagatcaatgactcctcagcattttcaatcatatgtgatgagacaatcaatagtgccatgaaagaacagctttcaatttgtgtaagatacccacaaaaatcatcaaaggctatcttaattaaggaaagattcttgggttttgttgatactgaggagatgactgggacccacttacataggactatcaaaacttatctgcagcaaattggagttgatatggataaaatacatggccaggcctatgatagcaccactaatttgaagataaaatttaataaaatagcagcagaattcaagaaagaagaaccaagagctttatacatacattgttatgcacactttttggatttatcaataattaggttttgtaaagaagtaaaagaactccgaagtgctctaaaaactctcagttctttgttcaacactatttgtatgtctggggaaatgttggcaaattttcgaaacatttataggctaagtcaaaacaaaacatgcaagaaacatatatcacaatcatgttggacagtccatgatcgtacattactatctgtgattgacagtcttccagagattattgaaacattggaagttatagcaagccattcttcaaatacaagtttcgccgatgaattgagtcatttgctgacattggtttccaaatttgaatttgtcttttgtttgaaattcctgtatcgagtgctgagtgttacaggaattctttccaaagagcttcaaaataaaaccatagacattttttctttgtcttcaaaaatagaagcaattttggaatgtttatcatctgaaagaaatgacgtatactttaaaacaatctgggatggaacagaggaaatatgtcaaaaaataacctgtaaaggttttaaagttgaaaaaccttctcttcagaaaagaagaaaaattcagaaatcagtagatcttggcaattcagataatatgttttttcctacttcaacagaagaacaatataaaattaatatctattaccaaggattagatactatattacaaaatttaaagttatgtttttcggagtttgattattgcaaaataaagcaaatttcagaactgttatttaaatggaatgaaccattaaatgaaacaacagcaaaacatgttcaggaattttataaacttgatgaggacattatcccagaacttagattttatcgacattatgcaaagcttaactttgtcatagatgatagttgcataaacttcgtcagtctcggctgtttgtttattcagcatggtcttcacagtaatattccttgtctctcaaagctattatatattgctttgtcttggccaattacttcagcaagtactgagaactcattttctaccctgcctcgtcttaagacatatttatgtaataccatgggacaagagaagcttactggcccagccctaatggctgttgagcaggagttggtaaataaactaatggagcctgaaagactcaatgaaattgtggaaaagtttatcagtcagatgaaagaaatataatacatgctcatttgaacttacctaaaagacttgtatttccattgggatgttttcatttcaaaattgttcaaaattcaaaagacacagaacgataaacagtgaagtctccttccctcctttagaactcattttctcttcccaaaaagtgttatcttttccttaaatatccctctagaggtatttttcctaagtggtattgtacggtgtatactgttcttcagcttgtcttctctgtgtaacatatttttgagattgtcccatgtcgttacatgaagagtttcttgattcttggtctataattgcagatgttattgtatgaatgtaccataatatatttgagcagtccctgctgacatttttttcctaaccttttgctattataaataatgattcattttataaccttttatataggtcacattgcacatgagtgagtttactgtaagctggaaatctaaagttagaattactaggttaagatatgtgcatttttacttttgatagatattggcaagttgccatctataaggattgtgccagtttacagtcccacccacaatgcatgagagtgcctattaaatctttgtaagtgttatcaaa

SEQ ID NO: 204615 - DNA, 1825 bp, Homo sapiens
  Payload ID: 20361
  Gene Name: zinc finger, MYM-type 1
  ENST ID: ENST00000417119
  CDS Start-End: 441-1825
agcattcttataggagtctccagcctctctttgcagttttcaagacaggaagttgacttcttccttgcagctccttccacagtgaacaacttggctgtcagagaggttctgattacaaaacccagtccagccacaaaaagcttctgcagaagcctgcctaatgtttacaaacctacgatgcagccactacaattatccccatttcaaggtcgaagaaatggagatttatagaagttgtcaaatcgcttactagcacacagctaataagtagtaaagccatctctcaaatccaggaaatctaactgccctgcctgagctctgagtcaagggtcctactttggctgccagccagcgacgacttcaagggaatctggaaactgttcttcaggaagaaacccattagtttggaactggagaattcctttgcatcagatactaaaatgaaagaaccacttttaggtggtgagtgtgacaaggcagtggcatcacagctggggctgctagatgaaattaagacagaacccgacaatgctcaagagtattgtcataggcaacagtccagaactcaggagaatgaactgaaaataaatgctgtgttttcagagagtgcttcacagttgactgcaggcattcagctttctctggcatcatctggcgtgaataaaatgcttccttcagtttcaaccacagctattcaggtttcctgtgctggttgtaaaaaaattctccagaaggggcaaactgcttatcagaggaaaggatctgctcaacttttctgctccataccatgcatcactgaatacatttcatctgccagttcaccagttccttctaagagaacttgttcaaactgctcaaaagacattttaaatccaaaggatgtgattagtgtccagctggaagacactacctcttgcaaaactttttgcagcctatcttgtctttcatcatatgaagaaaaaagaaaaccatttgttaccatatgtactaatagcattttgaccaagtgcagcatgtgccagaagactgctattattcagtatgaagtaaaataccaaaatgtgaaacataatctttgcagtaatgcctgcctttcaaagtttcactctgctaacaacttcatcatgaactgctgtgagaactgtggcacttactgttacaccagctctagtctgtcccacatacttcagatggaaggacagtctcattactttaatagttcaaagagtattacagcatataagcagaaacctgccaaaccacttatatctgttccttgcaaaccattgaagccctcagatgaaatgattgagactacgagtgatttggggaagacagagcttttctgctctattaattgtttctctgcatacagtaaagctaagatggaatcttcttcagtaagtgttgtttctgtggtgcatgatacttcaacagagcttctttctccaaagaaagatacgactccagttataagcaatatagtgtcattggcagacaccgatgttgccttgcccatcatgaacactgatgtcttacaagatacagtttcttcagtaacagcaacagcagatgtcattgtggatctttctaagagttcacctagtgaacccagtaatgctgttgctagtagtagtacggaacagccaagcgtttcaccatcttcatcagtattcagtcagcatgcaattggttccagtacagaagtacaaaaagacaatatgaaatctatgaaaataagtgatgaactatgtcacccaaaatgtacatccaaagtacaaaaagttaaaggtaaatcacgaagtattaaaaaatcttgttgtgc

SEQ ID NO: 204616 - DNA, 4466 bp, Homo sapiens
  Payload ID: 20361
  Gene Name: zinc finger, MYM-type 1
  Uniprot ID: Q5SVZ6
  ENST ID: ENST00000611874
  CDS Start-End: 441-3869
agcattcttataggagtctccagcctctctttgcagttttcaagacaggaagttgacttcttccttgcagctccttccacagtgaacaacttggctgtcagagaggttctgattacaaaacccagtccagccacaaaaagcttctgcagaagcctgcctaatgtttacaaacctacgatgcagccactacaattatccccatttcaaggtcgaagaaatggagatttatagaagttgtcaaatcgcttactagcacacagctaataagtagtaaagccatctctcaaatccaggaaatctaactgccctgcctgagctctgagtcaagggtcctactttggctgccagccagcgacgacttcaagggaatctggaaactgttcttcaggaagaaacccattagtttggaactggagaattcctttgcatcagatactaaaatgaaagaaccacttttaggtggtgagtgtgacaaggcagtggcatcacagctggggctgctagatgaaattaagacagaacccgacaatgctcaagagtattgtcataggcaacagtccagaactcaggagaatgaactgaaaataaatgctgtgttttcagagagtgcttcacagttgactgcaggcattcagctttctctggcatcatctggcgtgaataaaatgcttccttcagtttcaaccacagctattcaggtttcctgtgctggttgtaaaaaaattctccagaaggggcaaactgcttatcagaggaaaggatctgctcaacttttctgctccataccatgcatcactgaatacatttcatctgccagttcaccagttccttctaagagaacttgttcaaactgctcaaaagacattttaaatccaaaggatgtgattagtgtccagctggaagacactacctcttgcaaaactttttgcagcctatcttgtctttcatcatatgaagaaaaaagaaaaccatttgttaccatatgtactaatagcattttgaccaagtgcagcatgtgccagaagactgctattattcagtatgaagtaaaataccaaaatgtgaaacataatctttgcagtaatgcctgcctttcaaagtttcactctgctaacaacttcatcatgaactgctgtgagaactgtggcacttactgttacaccagctctagtctgtcccacatacttcagatggaaggacagtctcattactttaatagttcaaagagtattacagcatataagcagaaacctgccaaaccacttatatctgttccttgcaaaccattgaagccctcagatgaaatgattgagactacgagtgatttggggaagacagagcttttctgctctattaattgtttctctgcatacagtaaagctaagatggaatcttcttcagtaagtgttgtttctgtggtgcatgatacttcaacagagcttctttctccaaagaaagatacgactccagttataagcaatatagtgtcattggcagacaccgatgttgccttgcccatcatgaacactgatgtcttacaagatacagtttcttcagtaacagcaacagcagatgtcattgtggatctttctaagagttcacctagtgaacccagtaatgctgttgctagtagtagtacggaacagccaagcgtttcaccatcttcatcagtattcagtcagcatgcaattggttccagtacagaagtacaaaaagacaatatgaaatctatgaaaataagtgatgaactatgtcacccaaaatgtacatccaaagtacaaaaagttaaaggtaaatcacgaagtattaaaaaatcttgttgtgcagattttgagtgtttggaaaacagtaaaaaagatgtggcattctgttattcatgccagttgttctgccaaaaatattttagctgtggaagagagtcatttgcaacccacggaacttctaattggaaaaaaaccctggaaaaattcagaaagcatgaaaaaagtgaaatgcatttgaagtcattggaattttggagagaataccaattttgtgatggagctgtcagtgacgatttatctattcattcgaaacagattgagggaaataaaaagtacctaaagcttataattgaaaatattttatttcttggaaagcagtgtttacccttaagaggaaacgaccagtcagtttcatctgtgaataaaggcaattttttagaattgttagaaatgagagcaaaagataaaggagaagaaacatttcgacttatgaattcacaagttgacttctataacagtacacaaattcaaagtgatattatcgaaataataaagactgaaatgttgcaggatattgtgaatgagatcaatgactcctcagcattttcaatcatatgtgatgagacaatcaatagtgccatgaaagaacagctttcaatttgtgtaagatacccacaaaaatcatcaaaggctatcttaattaaggaaagattcttgggttttgttgatactgaggagatgactgggacccacttacataggactatcaaaacttatctgcagcaaattggagttgatatggataaaatacatggccaggcctatgatagcaccactaatttgaagataaaatttaataaaatagcagcagaattcaagaaagaagaaccaagagctttatacatacattgttatgcacactttttggatttatcaataattaggttttgtaaagaagtaaaagaactccgaagtgctctaaaaactctcagttctttgttcaacactatttgtatgtctggggaaatgttggcaaattttcgaaacatttataggctaagtcaaaacaaaacatgcaagaaacatatatcacaatcatgttggacagtccatgatcgtacattactatctgtgattgacagtcttccagagattattgaaacattggaagttatagcaagccattcttcaaatacaagtttcgccgatgaattgagtcatttgctgacattggtttccaaatttgaatttgtcttttgtttgaaattcctgtatcgagtgctgagtgttacaggaattctttccaaagagcttcaaaataaaaccatagacattttttctttgtcttcaaaaatagaagcaattttggaatgtttatcatctgaaagaaatgacgtatactttaaaacaatctgggatggaacagaggaaatatgtcaaaaaataacctgtaaaggttttaaagttgaaaaaccttctcttcagaaaagaagaaaaattcagaaatcagtagatcttggcaattcagataatatgttttttcctacttcaacagaagaacaatataaaattaatatctattaccaaggattagatactatattacaaaatttaaagttatgtttttcggagtttgattattgcaaaataaagcaaatttcagaactgttatttaaatggaatgaaccattaaatgaaacaacagcaaaacatgttcaggaattttataaacttgatgaggacattatcccagaacttagattttatcgacattatgcaaagcttaactttgtcatagatgatagttgcataaacttcgtcagtctcggctgtttgtttattcagcatggtcttcacagtaatattccttgtctctcaaagctattatatattgctttgtcttggccaattacttcagcaagtactgagaactcattttctaccctgcctcgtcttaagacatatttatgtaataccatgggacaagagaagcttactggcccagccctaatggctgttgagcaggagttggtaaataaactaatggagcctgaaagactcaatgaaattgtggaaaagtttatcagtcagatgaaagaaatataatacatgctcatttgaacttacctaaaagacttgtatttccattgggatgttttcatttcaaaattgttcaaaattcaaaagacacagaacgataaacagtgaagtctccttccctcctttagaactcattttctcttcccaaaaagtgttatcttttccttaaatatccctctagaggtatttttcctaagtggtattgtacggtgtatactgttcttcagcttgtcttctctgtgtaacatatttttgagattgtcccatgtcgttacatgaagagtttcttgattcttggtctataattgcagatgttattgtatgaatgtaccataatatatttgagcagtccctgctgacatttttttcctaaccttttgctattataaataatgattcattttataaccttttatataggtcacattgcacatgagtgagtttactgtaagctggaaatctaaagttagaattactaggttaagatatgtgcatttttacttttgatagatattggcaagttgccatctataaggattgtgccagtttacagtcccacccacaatgcatgagagtgcctattaaatctttgtaagtgttatc

SEQ ID NO: 204617 - DNA, 5051 bp, Homo sapiens
  Payload ID: 20362
  Gene Name: zinc finger, MYM-type 2
  Uniprot ID: Q9UBW7
  ENST ID: ENST00000382871
  CDS Start-End: 186-4319
cgaaggggggtgggccgggggaggggaggttcgttccgcggagccccagccagaaccgggaccaagaatcgccttcagccctgtctggtgcatccttggcagaaagtgaggaggaaaacacccccattgttagatgaggtcttaatcatggaacatttgaagtcacgtaaagaaggttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgt

SEQ ID NO: 204618 - DNA, 10139 bp, Homo sapiens
  Payload ID: 20362
  Gene Name: zinc finger, MYM-type 2
  Uniprot ID: Q9UBW7
  ENST ID: ENST00000382874
  CDS Start-End: 191-4324
ccgccgcctcctccgcctcctcctcctcaccagcgctaaagccgggactggaccgagcggagttgaccaagaatcgccttcagccctgtctggtgcatccttggcagaaagtgaggaggaaaacacccccattgttagatgaggtcttaatcatggaacatttgaagtcacgtaaagaaggttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcattcaaatttatcactgttttttctgacagactttccctttgtcctttctagttatgacttgggaatggggtaacttctttatgcatagtattaagggttatagtatgaagaaatcataaaattgcaagttttggtttgcattactctaatgtgggttcatttaatctgagatcttaaatatcttgcagccttaaatcactacaaacatttgcatttttattatgccagttatttccaaaatgtattgttatacatgtcacttatgtttttaagctaatattgactgtaggataatctccttgttcccctcaaaatagtcatgaaagtgtacatgaaaatatttttaaagaataaatttctttaaattacatacttttggatttcccccttaataagccccttactcatgtttagagaagattttgaatttcatttattccattctactgtgttctgaggattatatcaatttagaagttgatgtccagaacaggttatctgtatcagttctgagaatagaaacaacctacagtgctgtcccaatttgtacttttttttctttactcggaagttagatgtcagagggacacctcaaataagtgactgtgatcccctgccttgtaatgaagtggaaaagagagggtccctaaaaatctgggcaagtggtgtcctaattagttactgagttaaaacaagttcatgaatttaggccttttgggaaagaaagagaatgtaagatttaacctgtaaatgttaagaatagaaccaaagagagggccacagaccattagttgttaagaggtatcaatcttaacagcatattttctcttgtgcaatgaaaagaacaatcgtagctcttttgggcatcttaggtcttttattctttctggatggcttacatcgaatccttgtgatttatttaaagacacatttttcctggagaggagaaagatcttctctaaaatagccttaacactgagaacatattaggcctaattttaaaagtccaattcagataactcctcagaagtaaatgcagcacactaaaattcattatcacaaaacttaatatttgttaatatgtttcctctgtgctaaaaggctgctgctaaccatggtagttagggaggaagagaaagtaaaagacattagtgttcaaaaacttacatctttgggggtaaacaagacatatagtacatttaactcctagggaacttagaatatttatggtaggatagaaagagatgattgtggacacacacaagtaccccaaaaggccattatggtctagaataggtttcatagagaggattactaccacctgtgattatatggtatatgaaacatgagattttgtaacctggacattgcttttagctctgttggaaatggtcagtagagcaatttctgaatattttgatggtacggtgttgatggcatcagtccttttctgtggctttcagcccaacttaatacaagaggagttaaaaatagcacccaaaaggggtagctagagcaccctcaccatgcactaaagataaatctaaaaggtgttcaagtacattgaatcaagatgagtaatccaacttctatgttatgtaggatggatggagcacacaaattcttgcaaacattgtagaggtttttttaaacttcatccactaaggatttttttataataattacttttgaaaataaaatctcaactattttccaagttatgagtgtgctgctcttaaccctgtgagatgaaatcttcccatttggattacatatttgtagttctatatcgacatcagcagatggcaatagtatacaaatagtatacagcatgagccttccattgcttttatttctttgtttataagtatactataatccttcatctgaaacccttagggttttagaattcagaattttccccttttcagagagaatatatataatgtagattacataacaccctcaatggggcctggggcaacaccccataatcaaacattagtacattcatagtaactgggattaactatgtaaggcagtaagctacctgccttacatagtttaggtcaatttttgtcacaaacttatggaaaaactaggtttttagaaattttttggatctcagaattcgtgattagggattgctgacctctgtaaggaaactggtgtcaggtctagaattttccttctaatgaaatacgtagtcattttccccctttttaaattgcttagctttggtagaggtaactgaaggctttctttagaattcgtgtgttagattttaagaaaaatgcatgaaattgttaggacaggcataaatacaaatggcaattctagagccattacggaattttgaaacacttaacaattgctttcttttacttttcatcttgcctcaatacttgtagcattacaagtattccacgtaaataaacgtttatgaagagctgcagtcatgtcatggagccaggcatttattcattcaacaaataggttagtcttccacacacaatttcaggtgctgggaacacagaattaagacccagcccttcctctcaaggacttcgcgtagtttgggagaaacgggaatgggctggaatgtcagaataagatgggcacttaggccttattgagcatgatcacacttgtattttgaagtaaaataccctgatcaagtaatttaccaagaagctactttttgtgacacagctccgtctcctgaccgcggttccagacttcaccattacaccagtctattcccattctggaaagggagaggtatcagctcttagggggcagagattagcaaattgaaaaatagcagtgaaccagatggaaggctctcgatctttagaggttattaatcagtgtttgttcgttcaatttttaaccagtcaccttgctgttaagagcagaacataattggctggaatgtaatgtagggaatttttccctgttggatccctagcacctagaaaagttcctagcacctattaggtgttaataaatgattgttgaatgaatcagtgattacaagtacttttaagaattttgaaaataaaggaaccattggaaatacga

SEQ ID NO: 204619 - DNA, 10200 bp, Homo sapiens
  Payload ID: 20362
  Gene Name: zinc finger, MYM-type 2
  Uniprot ID: Q9UBW7
  ENST ID: ENST00000610343
  CDS Start-End: 252-4385
agcgcgcggagggcggggcctccccgggctcggccgcgccgccgcctcctccgcctcctcctcctcaccagcgctaaagccgggactggaccgagcggagttgtgcgtgtcgccgaaggggggtgggccgggggaggggaggttcgttccgcggagccccagccagaaccgggaccaagaatcgccttcagccctgtctggtgcatccttggcagaaagtgaggaggaaaacacccccattgttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcattcaaatttatcactgttttttctgacagactttccctttgtcctttctagttatgacttgggaatggggtaacttctttatgcatagtattaagggttatagtatgaagaaatcataaaattgcaagttttggtttgcattactctaatgtgggttcatttaatctgagatcttaaatatcttgcagccttaaatcactacaaacatttgcatttttattatgccagttatttccaaaatgtattgttatacatgtcacttatgtttttaagctaatattgactgtaggataatctccttgttcccctcaaaatagtcatgaaagtgtacatgaaaatatttttaaagaataaatttctttaaattacatacttttggatttcccccttaataagccccttactcatgtttagagaagattttgaatttcatttattccattctactgtgttctgaggattatatcaatttagaagttgatgtccagaacaggttatctgtatcagttctgagaatagaaacaacctacagtgctgtcccaatttgtacttttttttctttactcggaagttagatgtcagagggacacctcaaataagtgactgtgatcccctgccttgtaatgaagtggaaaagagagggtccctaaaaatctgggcaagtggtgtcctaattagttactgagttaaaacaagttcatgaatttaggccttttgggaaagaaagagaatgtaagatttaacctgtaaatgttaagaatagaaccaaagagagggccacagaccattagttgttaagaggtatcaatcttaacagcatattttctcttgtgcaatgaaaagaacaatcgtagctcttttgggcatcttaggtcttttattctttctggatggcttacatcgaatccttgtgatttatttaaagacacatttttcctggagaggagaaagatcttctctaaaatagccttaacactgagaacatattaggcctaattttaaaagtccaattcagataactcctcagaagtaaatgcagcacactaaaattcattatcacaaaacttaatatttgttaatatgtttcctctgtgctaaaaggctgctgctaaccatggtagttagggaggaagagaaagtaaaagacattagtgttcaaaaacttacatctttgggggtaaacaagacatatagtacatttaactcctagggaacttagaatatttatggtaggatagaaagagatgattgtggacacacacaagtaccccaaaaggccattatggtctagaataggtttcatagagaggattactaccacctgtgattatatggtatatgaaacatgagattttgtaacctggacattgcttttagctctgttggaaatggtcagtagagcaatttctgaatattttgatggtacggtgttgatggcatcagtccttttctgtggctttcagcccaacttaatacaagaggagttaaaaatagcacccaaaaggggtagctagagcaccctcaccatgcactaaagataaatctaaaaggtgttcaagtacattgaatcaagatgagtaatccaacttctatgttatgtaggatggatggagcacacaaattcttgcaaacattgtagaggtttttttaaacttcatccactaaggatttttttataataattacttttgaaaataaaatctcaactattttccaagttatgagtgtgctgctcttaaccctgtgagatgaaatcttcccatttggattacatatttgtagttctatatcgacatcagcagatggcaatagtatacaaatagtatacagcatgagccttccattgcttttatttctttgtttataagtatactataatccttcatctgaaacccttagggttttagaattcagaattttccccttttcagagagaatatatataatgtagattacataacaccctcaatggggcctggggcaacaccccataatcaaacattagtacattcatagtaactgggattaactatgtaaggcagtaagctacctgccttacatagtttaggtcaatttttgtcacaaacttatggaaaaactaggtttttagaaattttttggatctcagaattcgtgattagggattgctgacctctgtaaggaaactggtgtcaggtctagaattttccttctaatgaaatacgtagtcattttccccctttttaaattgcttagctttggtagaggtaactgaaggctttctttagaattcgtgtgttagattttaagaaaaatgcatgaaattgttaggacaggcataaatacaaatggcaattctagagccattacggaattttgaaacacttaacaattgctttcttttacttttcatcttgcctcaatacttgtagcattacaagtattccacgtaaataaacgtttatgaagagctgcagtcatgtcatggagccaggcatttattcattcaacaaataggttagtcttccacacacaatttcaggtgctgggaacacagaattaagacccagcccttcctctcaaggacttcgcgtagtttgggagaaacgggaatgggctggaatgtcagaataagatgggcacttaggccttattgagcatgatcacacttgtattttgaagtaaaataccctgatcaagtaatttaccaagaagctactttttgtgacacagctccgtctcctgaccgcggttccagacttcaccattacaccagtctattcccattctggaaagggagaggtatcagctcttagggggcagagattagcaaattgaaaaatagcagtgaaccagatggaaggctctcgatctttagaggttattaatcagtgtttgttcgttcaatttttaaccagtcaccttgctgttaagagcagaacataattggctggaatgtaatgtagggaatttttccctgttggatccctagcacctagaaaagttcctagcacctattaggtgttaataaatgattgttgaatgaatcagtgattacaagtacttttaagaattttgaaaataaaggaaccattggaaatacga

SEQ ID NO: 204620 - DNA, 1069 bp, Homo sapiens
  Payload ID: 20362
  Gene Name: zinc finger, MYM-type 2
  ENST ID: ENST00000620447
  CDS Start-End: 241-1069
ctcttattcccttctctgcctccttctggcagaaagggttgggttctcccaccaggttgtgtgtttttgatacatttttcttttttcctcctatcccaggaccaagaatcgccttcagccctgtctggtgcatccttggcagaaagtgaggaggaaaacacccccattccatacatgtgtatattactctctgccgtagtcacctggataccatctctggacttactagtgttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttct

SEQ ID NO: 204621 - DNA, 5536 bp, Homo sapiens
  Payload ID: 20363
  Gene Name: zinc finger, MYM-type 3
  Uniprot ID: Q14202
  ENST ID: ENST00000314425
  CDS Start-End: 132-4244
aaaggggccgcgacccctgtcccggctgctagggagggaggtagagaaggagcgcggggccgtcgctgtctgcagttctaggcttgtagcctttgcactaaccctgccgcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacggaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggccctccccgaccctgcagcttctgccgccgcagcctctctgacccctgttactacaacaaggttgaccgcacagtctaccagttctgcagccccagctgctggaccaagttccagcgcacaagccctgaggggggcattcacctgagctgtcactactgtcacagcctcttcagtggcaagcctgaggtcttggactggcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtcagtctcctgagtcaaaaccccagacaccctctcaaaccaaagtggagaacagcaacacagtgaggaccccagaggaaaatgggaatttgggcaagatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacagaagagtggaagccacaggtgatcgtgctgcccatcccagtgcccatcttcgtgccagtgcctatgcatctgtactgccagaaagtcccggtgcctttctcgatgcctatcccggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtgatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagaatcctctggacattaatcccagtgtagacttcctctttgattgtggcctggtagggcctgaggatgtgtctactgaacaagaccttccccgaaccatgaggaagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaagggtgatgagctgcgctttggccccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcagtacttgctggaaaataaccggatggtgaacattttcacggacctttactacctgacttttgttcaagaactcaacaagtctctgagtacctggcagcccacactcctccccaacaatacggtgttctctcgagtggaggaggagcacctctgggagtgtaagcaactgggggtctactcgccctttgtcctcctcaacaccctcatgttcttcaacactaagttttttgggctgcagacagctgaggaacacatgcaactctccttcaccaatgtggtgcggcagtcccgcaagtgtaccacccctcggggcaccaccaaggtggtgagcatccgctactatgccccagtccgccagaggaaagggcgagacacgggtcctggaaaacggaagagagaagatgaagcccctatcttagagcagcgtgagaaccgcatgaatcccctccgctgccctgtcaagttctatgaattctatctctcaaaatgtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattgtc

SEQ ID NO: 204622 - DNA, 1511 bp, Homo sapiens
  Payload ID: 20363
  Gene Name: zinc finger, MYM-type 3
  ENST ID: ENST00000373978
  CDS Start-End: 79-1128
gagtgggctccaggaggtagggcgagcagggtgtgacgggggccagactcttgagccagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacgggtacagaagagaagcgagcgcgttaggagagcagaacctccaaaacctgaggttgtagattccactgagagcaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaaggtggggccgagggagtagtgcattagagggctgtggaagggggtgtggttcttgggttataaataaaggtggctgatgggtcaagggctgggagaaataaaacaaataaagggggtttcaattgtatccgttatgttttatttttgaagctggctggtggatacacaggtctttgttacatcatcatctatactttttttgtatgcctgaaatatttcatgtttaaaacatttaaaaaataaaagtgaaggg

SEQ ID NO: 204623 - DNA, 1841 bp, Homo sapiens
  Payload ID: 20363
  Gene Name: zinc finger, MYM-type 3
  Uniprot ID: Q14202
  ENST ID: ENST00000373981
  CDS Start-End: 115-1602
gggaaccatttgaatgagaggaggggatcacgggtagagtgggctccaggaggtagggcgagcagggtgtgacgggggccagactcttgagccagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacggaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaaggtggggccgagggagtagtgcattagagggctgtggaagggggtgtggttcttgggttataaataaaggtggctgatgggtcaagggctgggagaaataaaacaaataaagggggtttcaattgtatccgttatgttttatttttgaagctggctggtggatacacaggtctttgttacatcatcatctatactttttttgtatgcctgaaatatttcatgtttaaaacatttaaaaaataaaagtgaagggacaaa

SEQ ID NO: 204624 - DNA, 1867 bp, Homo sapiens
  Payload ID: 20363
  Gene Name: zinc finger, MYM-type 3
  ENST ID: ENST00000373982
  CDS Start-End: 132-1625
aaaggggccgcgacccctgtcccggctgctagggagggaggtagagaaggagcgcggggccgtcgctgtctgcagttctaggcttgtagcctttgcactaaccctgccgcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacgggtacagaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaaggtggggccgagggagtagtgcattagagggctgtggaagggggtgtggttcttgggttataaataaaggtggctgatgggtcaagggctgggagaaataaaacaaataaagggggtttcaattgtatccgttatgttttatttttgaagctggctggtggatacacaggtctttgttacatcatcatctatactttttttgtatgcctgaaatatttcatgtttaaaacatttaaaaaataaaagtgaagggacaaatcc

SEQ ID NO: 204625 - DNA, 5253 bp, Homo sapiens
  Payload ID: 20363
  Gene Name: zinc finger, MYM-type 3
  ENST ID: ENST00000373984
  CDS Start-End: 121-3963
gacccctgtcccggctgctagggagggaggtagagaaggagcgcggggccgtcgctgtctgcagttctaggcttgtagcctttgcactaaccctgccgcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacgggtacagaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggccctccccgaccctgcagcttctgccgccgcagcctctctgacccctgttactacaacaaggttgaccgcacagtctaccagttctgcagccccagctgctggaccaagttccagcgcacaagccctgaggggggcattcacctgagctgtcactactgtcacagcctcttcagtggcaagcctgaggtcttggactggcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtcagtctcctgagtcaaaaccccagacaccctctcaaaccaaagtggagaacagcaacacagtgaggaccccagaggaaaatgggaatttgggcaagatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacagaagagtggaagccacaggtgatcgtgctgcccatcccagtgcccatcttcgtgccagtgcctatgcatctgtactgccagaaagtcccggtgcctttctcgatgcctatcccggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtgatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagaatcctctggacattaatcccagtgtagacttcctctttgattgtggcctggtagggcctgaggatgtgtctactgaacaagaccttccccgaaccatgaggaagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaaggccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcagtacttgctggaaaataaccggatggtgaacattttcacggacctttactacctgacttttgttcaagaactcaacaagtctctgagtacctggcagcccacactcctccccaacaacacgggtcctggaaaacggaagagagaagatgaagcccctatcttagagcagcgtgagaaccgcatgaatcccctccgctgccctgtcaagttctatgaattctatctctcaaaatgtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattg

SEQ ID NO: 204626 - DNA, 6021 bp, Homo sapiens
  Payload ID: 20363
  Gene Name: zinc finger, MYM-type 3
  ENST ID: ENST00000373988
  CDS Start-End: 613-4731
tccatagataatacagggagctcctgcaggaagactcagggagaagatcccagaacttaccctaagactgttgagagagtagggggtagctttgcaggacctggtttgggggtcatcaagcagtaacggttactgcacaggcgttgccactgagccagagccatttaacccgacctgtgtggctggggatcaagcttcagataccccataactctgactctcagactgttttgggggccccgtggctgcagacaagggaaggaggggcacgtgagggctgggtccctgcctccccccgtcctccgctgtcactcactaccccaacagtcgcccagggggcgggacccggagaggtggggatgggggagggtaatcttggcaggcgcctgctgcatggcgtaggtagggactattgaggggggcggacgccgagggggtgaacacgagtgggaagctaagagagacacggggagggggaggggaccgggaaccatttgaatgagaggaggggatcacgggtagagtgggctccaggaggtagggcgagcagggtgtgacgggggccagactcttgagccaggtaaggggagcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacgggtacagaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggccctccccgaccctgcagcttctgccgccgcagcctctctgacccctgttactacaacaaggttgaccgcacagtctaccagttctgcagccccagctgctggaccaagttccagcgcacaagccctgaggggggcattcacctgagctgtcactactgtcacagcctcttcagtggcaagcctgaggtcttggactggcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtcagtctcctgagtcaaaaccccagacaccctctcaaaccaaagtggagaacagcaacacagtgaggaccccagaggaaaatgggaatttgggcaagatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacagaagagtggaagccacaggtgatcgtgctgcccatcccagtgcccatcttcgtgccagtgcctatgcatctgtactgccagaaagtcccggtgcctttctcgatgcctatcccggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtgatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagaatcctctggacattaatcccagtgtagacttcctctttgattgtggcctggtagggcctgaggatgtgtctactgaacaagaccttccccgaaccatgaggaagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaagggtgatgagctgcgctttggccccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcagtacttgctggaaaataaccggatggtgaacattttcacggacctttactacctgacttttgttcaagaactcaacaagtctctgagtacctggcagcccacactcctccccaacaatacggtgttctctcgagtggaggaggagcacctctgggagtgtaagcaactgggggtctactcgccctttgtcctcctcaacaccctcatgttcttcaacactaagttttttgggctgcagacagctgaggaacacatgcaactctccttcaccaatgtggtgcggcagtcccgcaagtgtaccacccctcggggcaccaccaaggtggtgagcatccgctactatgccccagtccgccagaggaaagggcgagacacgggtcctggaaaacggaagagagaagatgaagcccctatcttagagcagcgtgagaaccgcatgaatcccctccgctgccctgtcaagttctatgaattctatctctcaaaatgtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattg

SEQ ID NO: 204627 - DNA, 6067 bp, Homo sapiens
  Payload ID: 20363
  Gene Name: zinc finger, MYM-type 3
  Uniprot ID: Q14202
  ENST ID: ENST00000373998
  CDS Start-End: 699-4775
gagagagagagagagagagagagagagagagagagagagagagagagagagagagagagagatcagccctggtgagggaggaaaactccatagataatacagggagctcctgcaggaagactcagggagaagatcccagaacttaccctaagactgttgagagagtagggggtagctttgcaggacctggtttgggggtcatcaagcagtaacggttactgcacaggcgttgccactgagccagagccatttaacccgacctgtgtggctggggatcaagcttcagataccccataactctgactctcagactgttttgggggccccgtggctgcagacaagggaaggaggggcacgtgagggctgggtccctgcctccccccgtcctccgctgtcactcactaccccaacagtcgcccagggggcgggacccggagaggtggggatgggggagggtaatcttggcaggcgcctgctgcatggcgtaggtagggactattgaggggggcggacgccgagggggtgaacacgagtgggaagctaagagagacacggggagggggaggggaccgggaaccatttgaatgagaggaggggatcacgggtagagtgggctccaggaggtagggcgagcagggtgtgacgggggccagactcttgagccaggtaaggggagcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacggaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggccctccccgaccctgcagcttctgccgccgcagcctctctgacccctgttactacaacaaggttgaccgcacagtctaccagttctgcagccccagctgctggaccaagttccagcgcacaagccctgaggggggcattcacctgagctgtcactactgtcacagcctcttcagtggcaagcctgaggtcttggactggcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtcagtctcctgagtcaaaaccccagacaccctctcaaaccaaagtggagaacagcaacacaatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacagaagagtggaagccacaggtgatcgtgctgcccatcccagtgcccatcttcgtgccagtgcctatgcatctgtactgccagaaagtcccggtgcctttctcgatgcctatcccggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtgatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagaatcctctggacattaatcccagtgtagacttcctctttgattgtggcctggtagggcctgaggatgtgtctactgaacaagaccttccccgaaccatgaggaagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaagggtgatgagctgcgctttggccccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcagtacttgctggaaaataaccggatggtgaacattttcacggacctttactacctgacttttgttcaagaactcaacaagtctctgagtacctggcagcccacactcctccccaacaatacggtgttctctcgagtggaggaggagcacctctgggagtgtaagcaactgggggtctactcgccctttgtcctcctcaacaccctcatgttcttcaacactaagttttttgggctgcagacagctgaggaacacatgcaactctccttcaccaatgtggtgcggcagtcccgcaagtgtaccacccctcggggcaccaccaaggtggtgagcatccgctactatgccccagtccgccagaggaaagggcgagacacgggtcctggaaaacggaagagagaagatgaagcccctatcttagagcagcgtgagaaccgcatgaatcccctccgctgccctgtcaagttctatgaattctatctctcaaaatgtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattgtc

SEQ ID NO: 204628 - DNA, 6994 bp, Homo sapiens
  Payload ID: 20364
  Gene Name: zinc finger, MYM-type 4
  Uniprot ID: Q5VZL5
  ENST ID: ENST00000314607
  CDS Start-End: 81-4727
agtgtgggcgggggccggggggccgagaggtaccgccgccaccgcgcggggagccgcagcggttccgagcggggcccaacatggcggagagagaggtggagtccggcccccgaaagaggtttgaacaaaaaagtggtgcagtttttgatgaaattgtagagaactgtggtggtatcatggatacagaaatgtctgaagatatagaccacaacttaactcctacccttgacagcatgtcttatggaatgccgaatcaaacaggatctgaaaattcattgctggatgaagatgattattttttgaactctggggatcttgcaggaattccagtcgttggtagtgacaatgaggatgaacaggattttagttcaaaggacaatcttgtttcttcaattcatactgatgatagcttggaagtagagagaagagtcacacagcatgaatcagacaatgaaaatgaaatacaaattcaaaataagttaaaaaaagactttcctaaacaatttgatcaggtttctgtctttaaatcaatacggaaagattttagtctagtaagagaaaacagcaaagagacattttctggaaaggagaaaaatagagacctaacttatgaacgtgaaaaacggttggataaaccccataaagatttggattcaaggttgaaaagcagtttttttgataaagcagctaatcaagttgaagaaacattacatacccatttaccacaaaccccagaaacaaactttagggattccagctacccatttgccaataaagaatccattggttcggaactggggaattcctttgcatcaaatattagaattaaagaagaacctttggatgatgagtatgacaaagcaatggcaccacagcagggactactagacaaaataaaagatgaacctgacaatgctcaagagtatagtcatggccaacagcaaaaaactcaagagggggaactgaaaattagtgctgtgttttcagtcagtggcagccctcttgctccacagttgactactggctttcagccctcactggcgtcatctggcatgaataaaatgcttccttcagttccagccacagctgttcgagtttcctgttctggttgtaaaaaaatcctccagaaggggcaaactgcttatcagaggaaagggtctactcagctattctgctccacactgtgcctcactggatatacagttccacctgcccgcccaccgcctcctctcaccaagaaaacttgttcaagttgctcaaaagacattttaaatccaaaggatgtgatcagtgcccagtttgaaaacaccaccactagtaaagatttttgcagtcagtcatgtttgtcaacatatgaactgaaaaaaaaacctattgttaccataaatacaaatagtatttcaaccaaatgcagcatgtgtcagaagaatgctgttattcgacatgaagttaattaccagaatgtggtccataaactttgcagtgatgcctgcttctctaagtttcgttctgctaacaacctcaccatgaactgttgtgagaactgtgggggttactgttacagtgggtcgggacaatgccacatgcttcagatagagggacagtctaagaagttttgtagttcatcgtgtatcacggcatacaagcagaaatcagccaaaattacaccgtgtgcgctttgcaaatcattgagatcctcagcagaaatgattgaaaataccaatagcttggggaagacagagcttttctgttctgttaattgcttatctgcttacagagttaaaatggttacttctgcaggtgtacaagttcagtgtaacagttgtaaaacctcagcaattcctcagtatcacctagccatgtcagatggaagtatacgcaacttctgcagctacagctgtgtggtagctttccagaatttattcaacaaaccaactggaatgaattcttcagtagtgcccttgtctcagggccaagtaattgtaagcatccccacaggttccacagtgtcagccggaggaggtagcacatctgctgtttctcccacctccatcagtagctctgctgcagctggtctccagcgtctcgctgcccagtcccagcatgttgggtttgcacgaagtgttgtgaaactcaaatgtcaacactgtaaccgtctttttgccacaaaaccagaacttcttgactataagggcaaaatgtttcagttctgtggcaagaattgttctgatgaatataagaaaataaataatgtaatggcaatgtgtgaatattgtaaaattgagaaaattgtaaaggagactgttcggttctcaggtgctgacaagtcattctgtagtgaaggttgcaaattgctttataaacatgacttggcaaaacgctggggaaatcactgtaaaatgtgcagttattgtttacagacatctcccaaattggtacagaataatttaggagggaaagtggaagagttctgttgtgaagaatgcatgtccaaatatacagttttgttctatcagatggccaaatgtgatgcttgtaagcgacagggtaaactcagtgagtccttgaaatggcgaggggaaatgaaacatttctgtaacctgctttgtatcttgatgttctgtaatcagcaaagtgtatgtgacccgccttcacaaaataatgcagcaaatatttccatggttcaagctgcttcagcaggacccccatctctgagaaaagattcgactccagttatagccaatgtagtatcattggcaagtgcccctgctgctcagcctacagtgaattctaacagtgtcttacaaggtgcagttccaacagtaacagcgaaaatcatcggtgatgcaagtactcaaacagatgccctgaaactgccaccttcccaacctccaaggcttttgaagaacaaagctttattatgcaaacccatcacacagactaaagccacctcttgcaaaccacatacccaaaacaaagaatgccagacagaagacactccaagtcagccccagattattgtggtgccagttcccgtaccagtgtttgttcccatacctcttcacctttatactcaatatgctccagtcccatttggaattccagttccaatgcctgtccctatgcttattccatcttcaatggatagtgaagataaagtcacagagagtattgaagacattaaagaaaagcttcccacacatccatttgaagctgatctccttgagatggcagaaatgattgcagaagatgaagagaagaagactctatctcagggagagtcccaaacttctgaacacgaactctttctagacaccaagatatttgaaaaagaccaaggaagtacatacagtggtgatcttgaatcagaggcagtatctactccacatagctgggaggaagagctgaatcactatgccttaaagtcaaatgctgtgcaagaggctgattcagaattgaagcagttctcaaaaggggaaactgaacaggacctggaagcagattttccatcagactcctttgacccacttaataaaggacagggaatccaggcacgttcccgaacaagacgacgacacagagatggcttcccccaacccagacgaagaggacggaagaagtctatagtggctgtggagcccaggagtcttattcaaggagcctttcaaggctgctcagtgtccgggatgacactgaaatacatgtatggggtaaatgcttggaagaactgggttcagtggaaaaatgccaaggaagagcagggggatctaaaatgtggaggggttgaacaggcctcatctagcccacgttctgaccccttaggaagtactcaagaccatgcactctctcaagaatcctcagagccaggctgtagagtccgctctatcaagctgaaggaagacattctgtcctgcacttttgctgagttgagtttgggcttatgccagtttatccaagaggtgcggagaccaaatggtgaaaaatatgatccagacagtatcttatacttgtgccttggaattcaacagtacctgtttgaaaatggtagaatagataacatttttactgagccctattccagatttatgattgaacttaccaaactcttgaaaatatgggaacctacaatacttcctaatggttacatgttctctcgcattgaggaagagcatttgtgggagtgcaaacagctgggcgcttactcaccaatcgtccttttaaacaccctccttttcttcaataccaaatacttccaactaaagaatgttactgagcacttgaagctttcctttgcccatgtgatgagacggaccaggactctgaagtacagtaccaagatgacatatctgaggttcttcccacctttacagaagcaggagtcagaaccagataaactgactgttggcaagaggaaacgaaatgaagatgatgaggttccagtgggggtggagatggcagagaatactgacaatccactaagatgcccagtccgactttatgagttttacctgtcaaaatgttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgattattgcttttttaattttatgaaaattgtgtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatatttgtatttga

SEQ ID NO: 204629 - DNA, 466 bp, Homo sapiens
  Payload ID: 20364
  Gene Name: zinc finger, MYM-type 4
  ENST ID: ENST00000441447
  CDS Start-End: 173-466
gagcggggcccaacatggcggagagagaggtggagtccggcccccgaaagagggaacatcgtgatcaattagccactgccaaagatccctgctggccaaaacattctgattaccgtttgaacaaaaaagtggtgcagtttttgatgaaattgtagagaactgtggtggtatcatggatacagaaatgtctgaagatatagaccacaacttaactcctacccttgacagcatgtcttatggaatgccgaatcaaacaggatctgaaaattcattgctggatgaagatgattattttttgaactctggggatcttgcaggaattccagtcgttggtagtgacaatgaggatgaacaggattttagttcaaaggacaatcttgtttcttcaattcatactgatgatagcttggaagtagagagaagagtcacacagcatgaatcagacaatgaaaatgaaatacaaatt

SEQ ID NO: 204630 - DNA, 6003 bp, Homo sapiens
  Payload ID: 20364
  Gene Name: zinc finger, MYM-type 4
  ENST ID: ENST00000457946
  CDS Start-End: 1-3622
acctttggatgatgagtatgacaaagcaatggcaccacagcagggactactagacaaaataaaagatgaacctgacaatgctcaagagtatagtcatggccaacagcaaaaaactcaagagggggaactgaaaattagtgctgtgttttcagtcagtggcagccctcttgctccacagttgactactggctttcagccctcactggcgtcatctggcatgaataaaatgcttccttcagttccagccacagctgttcgagtttcctgttctggttgtaaaaaaatcctccagaaggggcaaactgcttatcagaggaaagggtctactcagctattctgctccacactgtgcctcactggatatacagttccacctgcccgcccaccgcctcctctcaccaagaaaacttgttcaagttgctcaaaagacattttaaatccaaaggatgtgatcagtgcccagtttgaaaacaccaccactagtaaagatttttgcagtcagtcatgtttgtcaacatatgaactgaaaaaaaaacctattgttaccataaatacaaatagtatttcaaccaaatgcagcatgtgtcagaagaatgctgttattcgacatgaagttaattaccagaatgtggtccataaactttgcagtgatgcctgcttctctaagtttcgttctgctaacaacctcaccatgaactgttgtgagaactgtgggggttactgttacagtgggtcgggacaatgccacatgcttcagatagagggacagtctaagaagttttgtagttcatcgtgtatcacggcatacaagcagaatttattcaacaaaccaactggaatgaattcttcagtagtgcccttgtctcagggccaagtaattgtaagcatccccacaggttccacagtgtcagccggaggaggtagcacatctgctgtttctcccacctccatcagtagctctgctgcagctggtctccagcgtctcgctgcccagtcccagcatgttgggtttgcacgaagtgttgtgaaactcaaatgtcaacactgtaaccgtctttttgccacaaaaccagaacttcttgactataagggcaaaatgtttcagttctgtggcaagaattgttctgatgaatataagaaaataaataatgtaatggcaatgtgtgaatattgtaaaattgagaaaattgtaaaggagactgttcggttctcaggtgctgacaagtcattctgtagtgaaggttgcaaattgctttataaacatgacttggcaaaacgctggggaaatcactgtaaaatgtgcagttattgtttacagacatctcccaaattggtacagaataatttaggagggaaagtggaagagttctgttgtgaagaatgcatgtccaaatatacagttttgttctatcagatggccaaatgtgatgcttgtaagcgacagggtaaactcagtgagtccttgaaatggcgaggggaaatgaaacatttctgtaacctgctttgtatcttgatgttctgtaatcagcaaagtgtatgtgacccgccttcacaaaataatgcagcaaatatttccatggttcaagctgcttcagcaggacccccatctctgagaaaagattcgactccagttatagccaatgtagtatcattggcaagtgcccctgctgctcagcctacagtgaattctaacagtgtcttacaaggtgcagttccaacagtaacagcgaaaatcatcggtgatgcaagtactcaaacagatgccctgaaactgccaccttcccaacctccaaggcttttgaagaacaaagctttattatgcaaacccatcacacagactaaagccacctcttgcaaaccacatacccaaaacaaagaatgccagacagacactccaagtcagccccagattattgtggtgccagttcccgtaccagtgtttgttcccatacctcttcacctttatactcaatatgctccagtcccatttggaattccagttccaatgcctgtccctatgcttattccatcttcaatggatagtgaagataaagtcacagagagtattgaagacattaaagaaaagcttcccacacatccatttgaagctgatctccttgagatggcagaaatgattgcagaagatgaagagaagaagactctatctcagggagagtcccaaacttctgaacacgaactctttctagacaccaagatatttgaaaaagaccaaggaagtacatacagtggtgatcttgaatcagaggcagtatctactccacatagctgggaggaagagctgaatcactatgccttaaagtcaaatgctgtgcaagaggctgattcagaattgaagcagttctcaaaaggggaaactgaacaggacctggaagcagattttccatcagactcctttgacccacttaataaaggacagggaatccaggcacgttcccgaacaagacgacgacacagagatggcttcccccaacccagacgaagaggacggaagaagtctatagtggctgtggagcccaggagtcttattcaaggagcctttcaaggctgctcagtgtccgggatgacactgaaatacatgtatggggtaaatgcttggaagaactgggttcagtggaaaaatgccaaggaagagcagggggatctaaaatgtggaggggttgaacaggcctcatctagcccacgttctgaccccttaggaagtactcaagaccatgcactctctcaagaatcctcagagccaggctgtagagtccgctctatcaagctgaaggaagacattctgtcctgcacttttgctgagttgagtttgggcttatgccagtttatccaagaggtgcggagaccaaatggtgaaaaatatgatccagacagtatcttatacttgtgccttggaattcaacagtacctgtttgaaaatggtagaatagataacatttttactgagccctattccagatttatgattgaacttaccaaactcttgaaaatatgggaacctacaatacttcctaatggttacatgttctctcgcattgaggaagagcatttgtgggagtgcaaacagctgggcgcttactcaccaatcgtccttttaaacaccctccttttcttcaataccaaatacttccaactaaagaatgttactgagcacttgaagctttcctttgcccatgtgatgagacggaccaggactctgaagtacagtaccaagatgacatatctgaggttcttcccacctttacagaagcaggagtcagaaccagataaactgactgttggcaagaggaaacgaaatgaagatgatgaggttccagtgggggtggagatggcagagaatactgacaatccactaagatgcccagtccgactttatgagttttacctgtcaaaatgttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgattattgcttttttaattttatgaaaattgtgtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatatttgtatttgatgggtgagttcttcttctttacgtcttaaaagaatttgaaatctctttttctgattgaccttattggtatgacccagcaattagtaaaattacaaagaaagagagcagtttccg

SEQ ID NO: 204631 - DNA, 3268 bp, Homo sapiens
  Payload ID: 20365
  Gene Name: zinc finger, MYM-type 5
  Uniprot ID: Q9UJ78
  ENST ID: ENST00000337963
  CDS Start-End: 266-2275
cgcgaaaagccgggactggacctcgcggagttgtgcttgtcgccgaagcggggtgggcttgttcgttccgcgcagccgcagccagaaccgggtgacgcttatccccgctgtctttccagtccagggccgctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaagaccaagactggagtaagaccttttaaccctggtagaatgaatgtggcaggagacttatttcagaatggagaatttgcaactcatcatagtcctgattcttggatctcccagtcagcttcatttcccagtaatcagaaacagccaggggtggattctttatcaccagtggccttacttcgtaagcagaatttccagcctacagcccaacaacaacttactaaaccagctaaaatcacttgtgcaaattgcaaaaagcctttacagaagggacagacagcttatcaacgaaaaggatcagctcacctcttttgctctaccacctgcctttcttccttctctcataaacgtactcaaaacacacgaagcataatatgtaaaaaagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagagattcgccatgaagtcagcgtaaataatgtaacacataaactgtgcagtaaccattgctttaataagtacagattggccaatggtctaataatgaactgctgtgaacactgtggagagtacatgcctagtaagagtactggaaacaacatcctggtgattggaggtcagcagaagagattttgctgccaaagttgtattaacgaatataaacagatgatggaaacaaaatcaaaaaaattaacagcatcagaaaatagaaaaaggaatgcttttagagaagaaaatgagaaacaattatatggatcgtcaaatacacttttgaaaaaaatagagggaatcccagaaaaaaaggaaaagacttcacagctacagctttcagtagaatgtggcacggatacattactgatccaagagaatgtgaatttacctccttcttccacgtcaaccatagctgatacatttcaagagcaactggaagagaaaaattttgaagactccattgtaccagttgtgctttccgcagatccaggtacgtggccccgaattttgaatattaaacaacgggacactcttgttgaaaatgttccgcctcaagtaagaaattttaactttccaaaagataatacagggaggaagttttcagaaacttattatacacggattcttccaaatggtgaaaaaaccactagatcctggttactttattcaacctcaaaagattctgtgttttgtctatattgcaaactctttggggaaggaaaaaatcaactgaaaaatgaaaatgggtgcaaagattggcaacatttatcacatattcttagtaaacatgaagaaagtgaaatgcacgtcaacaatagtgttaagtactcaaaattaaaatctgatctgaaaaaaaataaagctattgatgctgcagaacacagattatatgaaaatgagaaaaatgatggtgtgctgttgttgtacacgtaatatacctgagttgttttttggcatgatgatcagaatcttacattactcagaaaacatctgtcctgcaatagtcagtactattgtgttgtaagtctcctctacagagtaacttgcagcagttccttagcaataagtatgatagcaaataaatagcaaagaatgtttccattctaaatctaaaactaattagattcaatcatcattaggcaatgacttcattaggcaatgaagattaacaataggtaattgttaatcttcaaaatctatcaatttacacctatttaaaaattggcatttaatgactgccatttgatgggtttggttaatattctgttcttggccgggcgcaatggctcacgcctgtaatccaagaactttgggaggctcaggcgggtagatcaattgaggtcagaagttcaagaccagcctggccaacgtggcaaaacctcgtctttactaaaaatacaaaaattagccaggtgtggtggcacacacctgtagtcccagctactcaggaggctgaggcaggagaatcgcttgaacccaggaggcagaggttgcagtgagctgagattgcaccactgcagtccagcctgagcaacagagcgagagtcagtctcaaaagaaagaaaaatattatgttctaattaccttgaaagaggaaagaaaggcttgaattgatcaataccagtttgaataagatacttatgtgaacaagcattctcaacattattattaaagtaaaactactcagtttacagaatgggatctgaaactacagctttttgctattaaaccaaatacttgtgatctactttgtttgagcaaaacagcattatttgttatgttaatgatggttaatttccattttattggttttatgtttattttaatttgtaaatgttttagcatttattattgtatgtgaactatatttacctattttatgttgataaaaatataaaaaatattaaaataagtatatattaagtt

SEQ ID NO: 204632 - DNA, 1382 bp, Homo sapiens
  Payload ID: 20365
  Gene Name: zinc finger, MYM-type 5
  Uniprot ID: Q9UJ78
  ENST ID: ENST00000382905
  CDS Start-End: 154-1302
tttccagtccagggccgctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaagaccaagactggagtaagaccttttaaccctggtagaatgaatgtggcaggagacttatttcagaatggagaatttgcaactcatcatagtcctgattcttggatctcccagtcagcttcatttcccagtaatcagaaacagccaggggtggattctttatcaccagtggccttacttcgtaagcagaatttccagcctacagcccaacaacaacttactaaaccagctaaaatcacttgtgcaaattgcaaaaagcctttacagaagggacagacagcttatcaacgaaaaggatcagctcacctcttttgctctaccacctgcctttcttccttctctcataaacgtactcaaaacacacgaagcataatatgtaaaaaagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagaggtctggatttttatacctaagttgttgtttaggctaacagtgataattttaacttttaagtgctattatgtactctttcatctacataatgcacgtgttctggatgtataacatgaagctgaaaggaagaataaggatatgttagaactatcttatgggatattttataaataaaattccatttgcatagc

SEQ ID NO: 204633 - DNA, 1092 bp, Homo sapiens
  Payload ID: 20365
  Gene Name: zinc finger, MYM-type 5
  Uniprot ID: Q9UJ78
  ENST ID: ENST00000382907
  CDS Start-End: 138-764
gctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaagaccaagactggagtaagaccttttaaccctggtagaatgaatgtggcaggagacttatttcagaatggagaatttgcaactcatcatagtcctgagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagaggtctggatttttatacctaagttgttgtttaggctaacagtgataattttaacttttaagtgctattatgtactctttcatctacataatgcacgtgttctggatgtataacatgaagctgaaaggaagaataaggatatgttagaactatcttatgggatattttataaataaaattccatttgcatagcatggaaagtaca

SEQ ID NO: 204634 - DNA, 2604 bp, Homo sapiens
  Payload ID: 20365
  Gene Name: zinc finger, MYM-type 5
  ENST ID: ENST00000502168
  CDS Start-End: 1-1980
ttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaagaccaagactggagtaagaccttttaaccctggtagaatgaatgtggcaggagacttatttcagaatggagaatttgcaactcatcatagtcctgattcttggatctcccagtcagcttcatttcccagtaatcagaaacagccaggggtggattctttatcaccagtggccttacttcgtaagcagaatttccagcctacagcccaacaacaacttactaaaccagctaaaatcacttgtgcaaattgcaaaaagcctttacagaagggacagacagcttatcaacgaaaaggatcagctcacctcttttgctctaccacctgcctttcttccttctctcataaacgtactcaaaacacacgaagcataatatgtaaaaaagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagagattcgccatgaagtcagcgtaaataatgtaacacataaactgtgcagtaaccattgctttaataagtacagattggccaatggtctaataatgaactgctgtgaacactgtggagagtacatgcctagtaagagtactggaaacaacatcctggtgattggaggtcagcagaagagattttgctgccaaagttgtattaacgaatataaacagatgatggaaacaaaatcaaaaaaattaacagcatcagaaaatagaaaaaggaatgcttttagagaagaaaatgagaaacaattatatggatcgtcaaatacacttttgaaaaaaatagagggaatcccagaaaaaaaggaaaagacttcacagctacagctttcagtagaatgtggcacggatacattactgatccaagagaatgtgaatttacctccttcttccacgtcaaccatagctgatacatttcaagagcaactggaagagaaaaattttgaagactccattgtaccagttgtgctttccgcagatccaggtacgtggccccgaattttgaatattaaacaacgggacactcttgttgaaaatgttccgcctcaagtaagaaattttaactttccaaaagataatacagggaggaagttttcagaaacttattatacacggattcttccaaatggtgaaaaaaccactagatcctggttactttattcaacctcaaaagattctgtgttttgtctatattgcaaactctttggggaaggaaaaaatcaactgaaaaatgaaaatgggtgcaaagattggcaacatttatcacatattcttagtaaacatgaagaaagtgaaatgcacgtcaacaatagtgttaagtactcaaaattaaaatctgatctgaaaaaaaataaagctattgatgctgcagaacacagattatatgaaaatgagaaaaatgatggtgtgctgttgttgtacacgtaatatacctgagttgttttttggcatgatgatcagaatcttacattactcagaaaacatctgtcctgcaatagtcagtactattgtgttgtaagtctcctctacagagtaacttgcagcagttccttagcaataagtatgatagcaaataaatagcaaagaatgtttccattctaaatctaaaactaattagattcaatcatcattaggcaatgacttcattaggcaatgaagattaacaataggtaattgttaatcttcaaaatctatcaatttacacctatttaaaaattggcatttaatgactgccatttgatgggtttggttaatattctgttcttggccgggcgcaatggctcacgcctgtaatccaagaactttgggaggctcaggcgggtagatcaattgaggtcagaagttcaagaccagcctggccaacgtggcaaaacctcgtctttactaaaaatacaaaaattagccaggtgtggtggcacacacctgtagtcccagctactcaggaggctgaggcaggagaatcgcttgaacccaggaggcagaggttgcagtgagctgagattgcaccactgcagtccagcctgagcaacagagcgagagtcagtctcaaaa

SEQ ID NO: 204635 - DNA, 2702 bp, Homo sapiens
  Payload ID: 20366
  Gene Name: zinc finger, MYM-type 6
  Uniprot ID: O95789
  ENST ID: ENST00000317538
  CDS Start-End: 166-678
ggaattccagaagagaaaataatccctgtctagatgcagaggacttggttcctattccagtgctcctccggtagcagggaggcgacagaaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaagtataaaattcttaacatccctttttactttaccttttttttagtgtgtatattgtttagttcaaacatactgttgatactttaaatctcttcagcatgtatctgtagaaataactttttagttaatggaagaattcaccaattttaaagttttgcaacattaaataagtgacttggtgttagaatattgcctaaaccagttttctatcactttaaattttactatggaaagaaataacaaatgacatgtgggaattgcaggactatcctgtaattgtagacacccaccatttaaatttatttaacagttatcttgaaagctattgggtatagcataaaataatatcactcttttaatagtatacaaaagctatttaattctttaaaaagtaaaaactctacatggtcgcaaaaatgtgtttatttctaatgtccttgtggggtcattgttgctttacaataatgcttagatgcagagagaggaaaaaacagcaacaaagtcacataaatctttccctgacttagtacatttgaaggatttggcatattttgcctatttctgtggtagtgtaatttgaggaatacagtgtgttgttaatagtcactacaggcaaaaaacagtaagagcttgcttttaaattgtggctctgtcatttatctctgtgacttcgggctagatgtttaactttctaagcctccatttctcatcagtaaataatagttgcttcctaggactttaatgagacagtgttagcaaatggcctagcacatagcaagtacttaaaaaatggaatcctgttattattaataataaaaattatatcgtgcgattatttataattaacataaataaatataataaatatatgtgtatataatacatattactatgtatacttaacatatcacttgtaggcccctattttgtctttggctgtgtttatctgctttgtgtcttgacttaaactatttaaaagtagatcctgctatatggaaatttccaagtaaagaggagagaggatttttttttttctttgttgcccatggtagagtgatcacagctcactgcagccttgaactccccgggctcagatgatcctcccacctcagcctttcaaatagctgggaccacaggcgcataccaccatgcccgactaatttttgtatttttttgtagagatggttttgctatgttgcccaggctggtctcaaactcctgggctcaagcaattagcctgcctcagcctcctaaagtgctgggactattggtgtgagccatcacatgtggccaggagagaggaattttaaaatatttatatactctaaattagtttgttgcaaaataccattctaattaatgcttttatgtcattctcatgaaactaatctgaaagagtaaacttagttttctatttttagatattgtttcaacataccaaataccaaaataaaattaaataattttaaagaacataacacaacttatacatccaaatgcctattgttttcttaaaagtagtcacccccgtcagtgactttttagcataaggttaggagacagattcttatcttttcagcatgcatttgatttttacaaattttcaaaggctgcttgataccttaatcaggccaatatattagctaattaaattaagtcatactgttaaaacatgatatttataaaattaaaagttaaaaaatagtctaagggtttatcttaagttttatcttaaaaaaattagaaaaatgttttgagctatgttattgttggaaggtgtggtttttctacggtaaatgttacgatataacactcatttgcatgtgtaaggttcagagtacacttataatttatgtgcacagattttcattataaagtcattctctttgatttacatatttttacttgctatttttgtacttattatgccactggcagattcaccttattaagtgaaactctttattgctctgttttcagtagaaaaatcacttttcaaaattaatacttcatctgtgtataagcatattcttttggtttctaagatttgctgtcatatttttaaagttgagttttaaagaattaaaataatttttgttgttgttattttc

SEQ ID NO: 204636 - DNA, 4330 bp, Homo sapiens
  Payload ID: 20366
  Gene Name: zinc finger, MYM-type 6
  Uniprot ID: O95789
  ENST ID: ENST00000357182
  CDS Start-End: 229-4206
gagggcggagaccaaggctgcgcaggcgtggttggccggtcgttgcgttgggatggatcaggcggaattccagaagagaaaataatccctgtctagatgcagaggacttggttcctattccagtgctcctccggtagcagggaggcgacagaaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaaagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatactcgatttgaagttaaatatcaaaatgtggtacatggtctttgtagtgatgcctgtttttcaaaatttcactctacaaacaacctcaccatgaactgttgtgagaactgtgggagctattgctatagtagctctggtccttgccaatcccagaaggtttttagttcaacaagtgtcacggcatacaagcagaattctgcccaaattcctccatatgccctggggaagtcattgaggccctcagctgaaatgattgagactacaaatgattcaggaaaaacagagcttttctgctctattaattgcttatctgcttacagagttaagactgttacttcttcaggtgtccaggtttcatgtcatagttgtaaaacctcagcaatccctcagtatcacctagccatgtcaaatggaactatatacagcttctgcagctccagttgtgtggttgctttccagaatgtatttagcaagccaaaaggaacaaactcttcggcggtgcccctgtctcagggccaagtggttgtaagcccgccctcctccaggtcagcagtgtcaataggaggaggtaacacctctgccgtttcccccagctccatccgtggctctgctgcagccagcctccaacctcttgctgaacaatcccagcaagttgctttaacccatacagttgttaaactcaagtgtcagcactgtaaccatctatttgccacaaaaccagaacttcttttttacaagggtaaaatgtttctgttttgtggcaagaattgctctgatgaatacaagaagaaaaataaagttgtggcaatgtgtgactactgtaaactgcagaaaattataaaggagactgtgcgattctcaggggttgataagccattctgtagtgaagtttgcaaattcctctctgcccgtgactttggagaacgatggggaaactactgtaagatgtgcagctactgttcacagacatccccaaatttggtagaaaatcgattggagggcaagttagaagagttttgttgtgaagattgtatgtccaaatttacagttctgttttatcagatggccaagtgtgatggttgtaaacgacagggtaaactaagcgagtccataaagtggcgaggcaacattaaacatttctgtaacctattttgtgtcttggagttttgtcatcagcaaattatgaatgactgtcttccacaaaataaagtaaatatttctaaagcaaaaactgctgtgacggagctcccttctgcaaggacagatacaacaccagttataaccagtgtgatgtcattggcaaaaatacctgctaccttatctacagggaacactaacagtgttttaaaaggtgcagttactaaagaggcagcaaagatcattcaagatgaaagtacacaggaagatgctatgaaatttccatcttcccaatcttcccagccttccaggcttttaaagaacaaaggcatatcatgcaaacccgtcacacagaccaaggccacttcttgcaaaccacatacacagcacaaagaatgtcagacagatttacctatgcctaatgaaaaaaatgatgcagaacttgattctccaccttcaaagaaaaaaagattaggttttttccagacttatgatacagaatatttaaaagttggttttattatctgtcctggatcaaaagaaagttcaccaaggccacagtgtgtcatttgtggagagatcttatccagtgaaaacatgaagccagcaaatctttctcatcatttgaagacaaaacattcagaattagaaaacaaaccagtagatttttttgaacaaaaatctttagaaatggaatgtcaaaatagttctttaaaaaagtgtttactagttgaaaagtcacttgtgaaagcttcttatttaattgctttccaaactgctgcaagcaagaagccattctccattgctgaagaattaattaaaccatatttagtagaaatgtgttcagaagttttgggttcaagtgctggagacaaaatgaaaactattccactttctaatgttacaattcaacacaggattgatgaactatctgcagacattgaagaccagctgattcaaaaggtcagagagtcaaagtggtttgcccttcagatagatgagtcatcagaaatctcaaatatcacacttcttttgtgctatattcgtttcattgattatgattgtcgtgatgtaaaagaagaattattattttgcattgaaatgcctactcaaataactggctttgaaatatttgaactaataaataaatatattgatagtaaatctctgaattggaaacattgtgttggtctctgtaccgatggggctgcaagcatgactggcaggtattctggtttaaaagcaaaaattcaagaagttgccatgaatacagcggcatttacacattgttttattcaccgtgaacgtttagtggcagaaaagttgtctccatgtttacataaaattcttttgcagtcagcacaaattttaagttttataaagagcaatgcattaaattcacgtatgttaacaattttgtgtgaagagatgggatctgagcatgtgagtttaccgcttcatgctgaagtacgttggatatcaagagggagaatgttaaaaagattatttgaattacgacatgagattgaaatatttttaagtcaaaagcattcagatttggccaagtattttcatgatgaggaatgggttggaaagctggcctacttatcagatatattttcacttataaatgaattaaatttaagtctccaaggaactttgactactttcttcaatttgtgtaataaaattgatgtatttaagagaaagttaaaaatgtggttgaagcgcacacaagagaatgattatgacatgttcccttcattttctgaattctcaaattcatcaggcttaaatatgacagacatcacaaggattatttttgagcacctggaaggactttctcaagtgttcagtgactgttttccaccagaacaagacttgcgttcaggaaatttgtggataattcacccttttatgaatcaccaaaataataatctcaccgacttcgaagaagaaaagctaacagagctatcttcagatttaggattacaagcactatttaaatcagtgtctgtaactcagttttggataaatgcaaagacaagttacccagaactccatgaaagggcaatgaaatttttattacccttttcaactgtttatttatgtgatgctgccttttcagctttgactgagtcaaaacaaaaaaatctgttgggttctggccctgccctaagacttgcagtcacatctttaattccaaggatagaaaaattagtgaaggagaaagagtagcaatatgcacattgcttaacagtgaagtcaataatcctgtgttaagttttgtataagtatcctaaaagataatttcctaatgtggatttgtgttttcagtgattaaatgttttaataatttttc

SEQ ID NO: 204637 - DNA, 1473 bp, Homo sapiens
  Payload ID: 20366
  Gene Name: zinc finger, MYM-type 6
  Uniprot ID: O95789
  ENST ID: ENST00000373333
  CDS Start-End: 206-718
agggacgcgttgacattcactggctagtccaccgctctcagtcggagaccacattgcctcgaaggcgattgtgaagcggggctctgaggggcttgatgccccccacccctcacacggagaccttgaaagaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaagtataaaattcttaacatccctttttactttaccttttttttagtgtgtatattgtttagttcaaacatactgttgatactttaaatctcttcagcatgtatctgtagaaataactttttagttaatggaagaattcaccaattttaaagttttgcaacattaaataagtgacttggtgttagaatattgcctaaaccagttttctatcactttaaattttactatggaaagaaataacaaatgacatgtgggaattgcaggactatcctgtaattgtagacacccaccatttaaatttatttaacagttatcttgaaagctattgggtatagcataaaataatatcactcttttaatagtatacaaaagctatttaattctttaaaaagtaaaaactctacatggtcgcaaaaatgtgtttatttctaatgtccttgtggggtcattgttgctttacaataatgcttagatgcagagagaggaaaaaacagcaacaaagtcacataaatctttccctgacttagtacatttgaaggatttggcatattttgcctatttctgtggtagtgtaatttgaggaatacagtgtgttgttaatagtcactacaggcaaaaaacagtaagagcttgcttttaaattgtggctctgtcatttatctctgtgacttcgggctagatgtttaactttctaagcctccatttctcatcagtaaataatagttgcttcctaggactttaatgagacagtgttagcaaatggcctagcacatagcaagtacttaaaaaatggaatcctgttattattaataataaaaattatatcgtgcgattatttataa

SEQ ID NO: 204638 - DNA, 807 bp, Homo sapiens
  Payload ID: 20366
  Gene Name: zinc finger, MYM-type 6
  ENST ID: ENST00000415531
  CDS Start-End: 182-807
tcgttagtcctcaatgatgggagtgggaattcttggtgggaaggagaatttcggaaagcgtgcggttctcagaggagggatgagcgcccgtagatattttgtggcgagtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaaagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatactcgatttgaagttaaatatca

SEQ ID NO: 204639 - DNA, 2896 bp, Homo sapiens
  Payload ID: 20367
  Gene Name: zinc finger, MYND-type containing 10
  Uniprot ID: O75800
  ENST ID: ENST00000231749
  CDS Start-End: 1274-2596
aaaaagatgtgatcaagagtgagttgggttggaggcagggactgctctggattaaatggccaagaaaggccatgctgaggtgtaaactgagccctgaaggaaaagtattccaggcaaagtgcaaaactctgaggcaaaaacctctttggaatgtatgagggaggttcagggaagcaaggaggagaggaaagaatccaagtcccgaggtacaggagaggacaagaagtagatcttgcagagctgctagtaagcggcatcccacctaacattttgagggccagaagtagccacagagcccctctcacgcaagggagtaatgtctatatgctttttttttttttttgagacggtctccctttgttgtccaggctggagtgcggtggtgcaatcttgcctcactgcaaactccacctcctgtgctcaagcgattctcctgcctcagtctcccatgtagctgggactacaggtgtgtgctaccacacctgtctaatttttgtacttttagtagagacagggtttcaccatgttgcccaggctggtctcaaactcctgacctcaagtgatccgcctgcctcggcctcccaaagtgctgagattacaggtgtcagccaccgcgcccggcctgatatacacttttaaggctccgggctgtccatgaggatcaagcgtggaagtaggtctacagaaaaggctgccgcagttcacccatgacaggtgatgacagtctggacatagggaggatggagagaagtcgtgcgccctggcagtatttcaggagccaactagtggagccgggacgcgagaaatagaggaaccaagaagccataaggaggaggaagagcagcgggtaggtcaagatgccacagccgcaggaggggctgttggggtcggggttacccccatccctgtgcaggcggacttggcgtctgaggacagagtccagaccacaaggatctggagctcaggagagactcgtgggccacagcccgagaaagcgctgggaatccaaatactatggcgattggcagtcgcgtaggcgaggcgggctagagacccgcccggatttaggcgcgagccacctccaggggcggggcccaggccgcactgcgcaggcgcggctaacccgtttccatggctgcgagaactgacgctccccaaccgtcccgcaactgtcctgtcccagactttggcaccgtcggggtccgtcgtccccgaatgtgacagcatccccaccccggctgctgcccaggatccgccggaccccggcctcgatatgggagacctggaactgctgctgcccggggaagctgaagtgctggtgcggggtctgcgcagcttcccgctacgcgagatgggctccgaagggtggaaccagcagcatgagaacctggagaagctgaacatgcaagccatcctcgatgccacagtcagccagggcgagcccattcaggagctgctggtcacccatgggaaggtcccaacactggtggaggagctgatcgcagtggagatgtggaagcagaaggtgttccctgtgttctgcagggtggaggacttcaagccccagaacaccttccccatctacatggtggtgcaccacgaggcctccatcatcaacctcttggagacagtgttcttccacaaggaggtgtgtgagtcagcagaagacactgtcttggacttggtagactattgccaccgcaaactgaccctgctggtggcccagagtggctgtggtggcccccctgagggggagggatcccaggacagcaaccccatgcaggagctgcagaagcaggcagagctgatggaatttgagattgcactgaaggccctctcagtactacgctacatcacagactgtgtggacagcctctctctcagcaccttgagccgtatgcttagcacacacaacctgccctgcctcctggtggaactgctggagcatagtccctggagccggcgggaaggaggcaagctgcagcagttcgagggcagccgttggcatactgtggccccctcagagcagcaaaagctgagcaagttggacgggcaagtgtggatcgccctgtacaacctgctgctaagccctgaggctcaggcgcgctactgcctcacaagttttgccaagggacggctactcaagcttcgggccttcctcacagacacactgctggaccagctgcccaacctggcccacttgcagagtttcctggcccatctgaccctaactgaaacccagcctcctaagaaggacctggtgttggaacagatcccagaaatctgggagcggctggagcgagaaaacagaggcaagtggcaggcaattgccaagcaccagctccagcatgtgttcagcccctcagagcaggacctgcggctgcaggcgcgaaggtgggctgagacctacaggctggatgtgctagaggcagtggctccagagcggccccgctgtgcttactgcagtgcagaggcttctaagcgctgctcacgatgccagaatgagtggtattgctgcagggagtgccaagtcaagcactgggaaaagcatggaaagacttgtgtcctggcagcccagggtgacagagccaaatgagggctgcagttgctgagggccgaccacccatgccaagggaatccacccagaatgcacccctgaacctcaagatcacggtccagcctctgccggagccccagtctccgcagtggagagcagagcgggcggtaaagctgctgaccgatctccctcctcctcaccccaagtgaaggctcgagacttcctgccccacccagtgggtaggccaagtgtgttgcttcagcaaaccggaccaggagggccagggccggatgtggggaccctcttcctctagcacagtaaagctggcctccagaaaca

SEQ ID NO: 204640 - DNA, 1757 bp, Homo sapiens
  Payload ID: 20367
  Gene Name: zinc finger, MYND-type containing 10
  Uniprot ID: O75800
  ENST ID: ENST00000360165
  CDS Start-End: 154-1461
aacccgtttccatggctgcgagaactgacgctccccaaccgtcccgcaactgtcctgtcccagactttggcaccgtcggggtccgtcgtccccgaatgtgacagcatccccaccccggctgctgcccaggatccgccggaccccggcctcgatatgggagacctggaactgctgctgcccggggaagctgaagtgctggtgcggggtctgcgcagcttcccgctacgcgagatgggctccgaagggtggaaccagcagcatgagaacctggagaagctgaacatgcaagccatcctcgatgccacagtcagccagggcgagcccattcaggagctgctggtcacccatgggaaggtcccaacactggtggaggagctgatcgcagtggagatgtggaagcagaaggtgttccctgtgttctgcagggtggaggacttcaagccccagaacaccttccccatctacatggtggtgcaccacgaggcctccatcatcaacctcttggagacagtgttcttccacaaggaggtgtgtgagtcagcagaagacactgtcttggacttggtagactattgccaccgcaaactgaccctgctggtggcccagagtggctgtggtggcccccctgagggggagggatcccaggacagcaaccccatgcaggagctgcagaagcaggcagagctgatggaatttgagattgcactgaaggccctctcagtactacgctacatcacagactgtgtggacaggcagtggtcagtctcccagcccccacagctggctcacttgaagagaattcaacgtctgcacccagtgtgctggttcctctccccaggcaagctgcagcagttcgagggcagccgttggcatactgtggccccctcagagcagcaaaagctgagcaagttggacgggcaagtgtggatcgccctgtacaacctgctgctaagccctgaggctcaggcgcgctactgcctcacaagttttgccaagggacggctactcaagcttcgggccttcctcacagacacactgctggaccagctgcccaacctggcccacttgcagagtttcctggcccatctgaccctaactgaaacccagcctcctaagaaggacctggtgttggaacagatcccagaaatctgggagcggctggagcgagaaaacagaggcaagtggcaggcaattgccaagcaccagctccagcatgtgttcagcccctcagagcaggacctgcggctgcaggcgcgaaggtgggctgagacctacaggctggatgtgctagaggcagtggctccagagcggccccgctgtgcttactgcagtgcagaggcttctaagcgctgctcacgatgccagaatgagtggtattgctgcagggagtgccaagtcaagcactgggaaaagcatggaaagacttgtgtcctggcagcccagggtgacagagccaaatgagggctgcagttgctgagggccgaccacccatgccaagggaatccacccagaatgcacccctgaacctcaagatcacggtccagcctctgccggagccccagtctccgcagtggagagcagagcgggcggtaaagctgctgaccgatctccctcctcctcaccccaagtgaaggctcgagacttcctgccccacccagtgggtaggccaagtgtgttgcttcagcaaaccggaccaggagggccagggccggatgtggggaccctcttcctctagcacagtaaagctggcctccaga

SEQ ID NO: 204641 - DNA, 562 bp, Homo sapiens
  Payload ID: 20367
  Gene Name: zinc finger, MYND-type containing 10
  ENST ID: ENST00000431869
  CDS Start-End: 143-256
atggctgcgagaactgacgctccccaaccgtcccgcaactgtcctgtcccagactttggcaccgtcggggtccgtcgtccccgaatgtgacagcatccccaccccggctgctgcccaggatccgccggaccccggcctcgatatgggagacctggaactgctgctgcccggggaagctgaagtgctggtgcggggtctgcgcagcttcccgctacgcgagatgggctccgaagggcaggtggaaccagcagcatgagaacctggagaagctgaacatgcaagccatcctcgatgccacagtcagccagggcgagcccattcaggagctgctggtcacccatgggaaggtcccaacactggtggaggagctgatcgcagtggagatgtggaagcagaaggtgttccctgtgttctgcagggtggaggacttcaagccccagaacaccttccccatctacatggtggtgcaccacgaggcctccatcatcaacctcttggagacagtgttcttccacaaggaggtgtgtgagtcagcagaagacactgtcttggacttggtaga

SEQ ID NO: 204642 - DNA, 1072 bp, Homo sapiens
  Payload ID: 20367
  Gene Name: zinc finger, MYND-type containing 10
  ENST ID: ENST00000442887
  CDS Start-End: 225-1072
atggctgcgagaactgacgctccccaaccgtcccgcaactgtcctgtcccagactttggcaccgtcggggtccgtcgtccccgaatgtgacagcatccccaccccggctgctgcccaggatccgccggaccccggcctcgatatgggagacctggaactgctgctgcccggggaagctgaagtgctggtggaaccagcagcatgagaacctggagaagctgaacatgcaagccatcctcgatgccacagtcagccagggcgagcccattcaggagctgctggtcacccatgggaaggtcccaacactggtggaggagctgatcgcagtggagatgtggaagcagaaggtgttccctgtgttctgcagggtggaggacttcaagccccagaacaccttccccatctacatggtggtgcaccacgaggcctccatcatcaacctcttggagacagtgttcttccacaaggaggtgtgtgagtcagcagaagacactgtcttggacttggtagactattgccaccgcaaactgaccctgctggtggcccagagtggctgtggtggcccccctgagggggagggatcccaggacagcaaccccatgcaggagctgcagaagcaggcagagctgatggaatttgagattgcactgaaggccctctcagtactacgctacatcacagactgtgtggacagcctctctctcagcaccttgagccgtatgcttagcacacacaacctgccctgcctcctggtggaactgctggagcatagtccctggagccggcgggaaggaggcaagctgcagcagttcgagggcagccgttggcatactgtggccccctcagagcagcaaaagctgagcaagttggacgggcaagtgtggatcgccctgtacaacctgctgctaagccctgaggctcaggcgcgctactgcctcacaagttttgccaagggacggctactcaagcttcgggccttcctcacagacacactgctggaccagctgcccaacctggcccacttgcagagtttcctggcccatctgaccctaactgaaacccagcctcctaa

SEQ ID NO: 204643 - DNA, 707 bp, Homo sapiens
  Payload ID: 20367
  Gene Name: zinc finger, MYND-type containing 10
  ENST ID: ENST00000443080
  CDS Start-End: 94-207
cagactttggcaccgtcggggtccgtcgtccccgaatgtgacagcatccccaccccggctgctgcccaggatccgccggaccccggcctcgatatgggagacctggaactgctgctgcccggggaagctgaagtgctggtgcggggtctgcgcagcttcccgctacgcgagatgggctccgaagggcaggtggaaccagcagcatgagaacctggagaagctgaacatgcaagccatcctcgatgccacagtcagccagggcgagcccattcaggagctgctggtcacccatgggaaggtcccaacactggtggaggagctgatcgcagtggagatgtggaagcagaaggtgttccctgtgttctgcagggtggaggacttcaagccccagaacaccttccccatctacatggtggtgcaccacgaggcctccatcatcaacctcttggagacagtgttcttccacaaggagctgcagaagcaggcagagctgatggaatttgagattgcactgaaggccctctcagtactacgctacatcacagactgtgtggacagcctctctctcagcaccttgagccgtatgcttagcacacacaacctgccctgcctcctggtggaactgctggagcatagtccctggagccggcgggaaggaggcaagctgcagcagttcgagggcagccgttggcatactgtggccccct

SEQ ID NO: 204644 - DNA, 4228 bp, Homo sapiens
  Payload ID: 20368
  Gene Name: zinc finger, MYND-type containing 11
  ENST ID: ENST00000309776
  CDS Start-End: 429-2072
agtgttcttgcagggctgctgatgggtggtcctgttcttttcgcggtcctgtttgcgcagagatgaaacggggaacttagcgtatccctaccgctctttttgatgacaggagtaaagggctgttcagactacctaaacaatgttgttaagagaagcactcgtacttctcagacttcgctgttccggaccccgcgagccaggggcaggcaccgggtccacccggggctgagctgcggcggcgcctgacaatgccccctcgcgccccggcctcggcgcccgctcccggctccagcgcgcctgcacgtacgtagccttcacgtgtgtgtggatacggagtgcatgtgtggagacagaggaatatgctccaacaaatttcggatagaggcgccgaagacaggacgtggggaagctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcatttagttattttttgaggttagagaataatttgtacatatttatttagacctttgatatttattaaagcaattactcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagctgctctgactagcaatatatagattcatttaatgtgttaacattggttaataaatgtattt

SEQ ID NO: 204645 - DNA, 2709 bp, Homo sapiens
  Payload ID: 20368
  Gene Name: zinc finger, MYND-type containing 11
  ENST ID: ENST00000381584
  CDS Start-End: 166-1923
ctaaagaagtaaacaggtcatggcacgtttaacaaaaagacgacaggcggatacaaaagctatccagcatctttgggcagccattgagattatacggaaccagaagcagattgccaacattgaccgtattacaaaatgtgaaacaactacattattcttgaacctatggtgatttttacatcattacacagatatgtcattttcattagttgtatcattgttataaactggtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagcc

SEQ ID NO: 204646 - DNA, 4229 bp, Homo sapiens
  Payload ID: 20368
  Gene Name: zinc finger, MYND-type containing 11
  Uniprot ID: Q15326
  ENST ID: ENST00000381591
  CDS Start-End: 254-2062
gcggccgccccgcgcgcatcgccatgtgagcggctgccgcggcttcgcggggacccaactttcccgggcggcggcgcccaacttcccgccgcccgctccggccccgcaggcccgcggcgccaggggaagacgcgagtaagtgcgggcggcggtgccctcccggccctcaccccgcacgcggcgacccggccgcctagcctccctcgctcaggcgcgaccgcggcgttctctgagctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcatttagttattttttgaggttagagaataatttgtacatatttatttagacctttgatatttattaaagcaattactcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagctgctctgactagcaatatatagattcatttaatgtgttaacattggttaataaatgtatttaaaaaaaacta

SEQ ID NO: 204647 - DNA, 4066 bp, Homo sapiens
  Payload ID: 20368
  Gene Name: zinc finger, MYND-type containing 11
  ENST ID: ENST00000381604
  CDS Start-End: 462-1910
acttctcgcgcaaatctgcagtgttcttgcagggctgctgatgggtggtcctgttcttttcgcggtcctgtttgcgcagagatgaaacggggaacttagcgtatccctaccgctctttttgatgacaggagtaaagggctgttcagactacctaaacaatgttgttaagagaagcactcgtacttctcagacttcgctgttccggaccccgcgagccaggggcaggcaccgggtccacccggggctgagctgcggcggcgcctgacaatgccccctcgcgccccggcctcggcgcccgctcccggctccagcgcgcctgcacctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcatttagttattttttgaggttagagaataatttgtacatatttatttagacctttgatatttattaaagcaattactcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagctgctctgactagcaatatatagattcatttaatgtgttaacattggttaataaatgtattt

SEQ ID NO: 204648 - DNA, 3898 bp, Homo sapiens
  Payload ID: 20368
  Gene Name: zinc finger, MYND-type containing 11
  Uniprot ID: Q15326
  ENST ID: ENST00000381607
  CDS Start-End: 96-1742
gcggcgggaaggaggcggcaccggaggggagggccgggcgcggcggcggcggcggtggaggagccggagcataatgctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcatttagttattttttgaggttagagaataatttgtacatatttatttagacctttgatatttattaaagcaattactcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagctgctctgactagcaatatatagattcatttaatgtgttaacattggttaataaatgtattt

SEQ ID NO: 204649 - DNA, 659 bp, Homo sapiens
  Payload ID: 20368
  Gene Name: zinc finger, MYND-type containing 11
  ENST ID: ENST00000397955
  CDS Start-End: 20-659
ctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgcctatagtatgcagcctttctccaggacagcagccccaaacaaggactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttc

SEQ ID NO: 204650 - DNA, 4138 bp, Homo sapiens
  Payload ID: 20368
  Gene Name: zinc finger, MYND-type containing 11
  Uniprot ID: Q15326
  ENST ID: ENST00000397959
  CDS Start-End: 429-1982
agtgttcttgcagggctgctgatgggtggtcctgttcttttcgcggtcctgtttgcgcagagatgaaacggggaacttagcgtatccctaccgctctttttgatgacaggagtaaagggctgttcagactacctaaacaatgttgttaagagaagcactcgtacttctcagacttcgctgttccggaccccgcgagccaggggcaggcaccgggtccacccggggctgagctgcggcggcgcctgacaatgccccctcgcgccccggcctcggcgcccgctcccggctccagcgcgcctgcacgtacgtagccttcacgtgtgtgtggatacggagtgcatgtgtggagacagaggaatatgctccaacaaatttcggatagaggcgccgaagacaggacgtggggaagctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattagcattaagaagaagaatacaaacaaacaggagatgggcacatacctcagattcattgtctcccgcatgaaggagaggaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcatttagttattttttgaggttagagaataatttgtacatatttatttagacctttgatatttattaaagcaattactcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagctgctctgactagcaatatatagattcatttaatgtgttaacattggttaataaatgtattt

SEQ ID NO: 204651 - DNA, 4306 bp, Homo sapiens
  Payload ID: 20368
  Gene Name: zinc finger, MYND-type containing 11
  Uniprot ID: Q15326
  ENST ID: ENST00000397962
  CDS Start-End: 342-2150
acttctcgcgcaaatctgcagtgttcttgcagggctgctgatgggtggtcctgttcttttcgcggtcctgtttgcgcagagatgaaacggggaacttagcgtatccctaccgctctttttgatgacaggagtaaagggctgttcagactacctaaacaatgttgttaagagaagcactcgtacttctcagacttcgctgttccggaccccgcgagccaggggcaggcaccgggtccacccggggctgagctgcggcggcgcctgacaatgccccctcgcgccccggcctcggcgcccgctcccggctccagcgcgcctgcacctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcatttagttattttttgaggttagagaataatttgtacatatttatttagacctttgatatttattaaagcaattactcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagctgctctgactagcaatatatagattcatttaatgtgttaacattggttaataaatgtattt

SEQ ID NO: 204652 - DNA, 1664 bp, Homo sapiens
  Payload ID: 20368
  Gene Name: zinc finger, MYND-type containing 11
  ENST ID: ENST00000403354
  CDS Start-End: 96-1664
gcggcgggaaggaggcggcaccggaggggagggccgggcgcggcggcggcggcggtggaggagccggagcataatgctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatga

SEQ ID NO: 204653 - DNA, 3950 bp, Homo sapiens
  Payload ID: 20368
  Gene Name: zinc finger, MYND-type containing 11
  ENST ID: ENST00000402736
  CDS Start-End: 71-1786
ggggagggccgggcgcggcggcggcggcggtggaggagccggagcataatgctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagaggaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcatttagttattttttgaggttagagaataatttgtacatatttatttagacctttgatatttattaaagcaattactcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagctgctctgactagcaatatatagattcatttaatgtgttaacattggttaataaatgtatttaaaaaaaa

SEQ ID NO: 204654 - DNA, 762 bp, Homo sapiens
  Payload ID: 20368
  Gene Name: zinc finger, MYND-type containing 11
  ENST ID: ENST00000439456
  CDS Start-End: 342-762
acttctcgcgcaaatctgcagtgttcttgcagggctgctgatgggtggtcctgttcttttcgcggtcctgtttgcgcagagatgaaacggggaacttagcgtatccctaccgctctttttgatgacaggagtaaagggctgttcagactacctaaacaatgttgttaagagaagcactcgtacttctcagacttcgctgttccggaccccgcgagccaggggcaggcaccgggtccacccggggctgagctgcggcggcgcctgacaatgccccctcgcgccccggcctcggcgcccgctcccggctccagcgcgcctgcacctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattagcattaagaagaagaatacaaacaaacaggagatgggcacatacctcagattcattgtctcccgcatgaaggagagggctatagatcttaataaaaaggggaaggacaataaacacccgatgtacaggaggctggtgcactcag

SEQ ID NO: 204655 - DNA, 2065 bp, Homo sapiens
  Payload ID: 20368
  Gene Name: zinc finger, MYND-type containing 11
  Uniprot ID: Q15326
  ENST ID: ENST00000509513
  CDS Start-End: 210-1913
ccggggctgagctgcggcggcgcctgacaatgccccctcgcgccccggcctcggcgcccgctcccggctccagcgcgcctgcacgtacgtagccttcacgtgtgtgtggatacggagtgcatgtgtggagacagaggaatatgctccaacaaatttcggatagaggcgccgaagacaggacgtggggaagctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtgggtaaataccagtcttttttagacccttatttctgaaaatgtaccacaggtatgatgcccgttaattcagaaggtagctgtggcacatgcagaagatgtttctgaaataagatcaaatgtgaaatggtcagctttagttttaaaaattttattaaaagtcctatgatctctcaa

SEQ ID NO: 204656 - DNA, 1859 bp, Homo sapiens
  Payload ID: 20368
  Gene Name: zinc finger, MYND-type containing 11
  Uniprot ID: Q15326
  ENST ID: ENST00000558098
  CDS Start-End: 1-1707
atggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtgggtaaataccagtcttttttagacccttatttctgaaaatgtaccacaggtatgatgcccgttaattcagaaggtagctgtggcacatgcagaagatgtttctgaaataagatcaaatgtgaaatggtcagctttagttttaaaaattttattaaaagtcctatgatctctcaa

SEQ ID NO: 204657 - DNA, 1687 bp, Homo sapiens
  Payload ID: 20368
  Gene Name: zinc finger, MYND-type containing 11
  Uniprot ID: Q15326
  ENST ID: ENST00000602682
  CDS Start-End: 24-1577
gcagctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattagcattaagaagaagaatacaaacaaacaggagatgggcacatacctcagattcattgtctcccgcatgaaggagaggaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcct

SEQ ID NO: 204658 - DNA, 3914 bp, Homo sapiens
  Payload ID: 20368
  Gene Name: zinc finger, MYND-type containing 11
  ENST ID: ENST00000627286
  CDS Start-End: 1-1758
atggtgatttttacatcattacacagatatgtcattttcattagttgtatcattgttataaactggtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcatttagttattttttgaggttagagaataatttgtacatatttatttagacctttgatatttattaaagcaattactcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagctgctctgactagcaatatatagattcatttaatgtgttaacattggttaataaatgtattt

SEQ ID NO: 204659 - DNA, 1775 bp, Homo sapiens
  Payload ID: 20369
  Gene Name: zinc finger, MYND-type containing 12
  Uniprot ID: Q9H0C1
  ENST ID: ENST00000372565
  CDS Start-End: 271-1368
actgtacgggcctttctggacttggactccttgggagtcgtttctcggccatttgacccgtgggacttgtgggttttgtgctgctttttctttctttcttccccttttccaacttcagcaatacacccagatgttagtcgagtcacgtcccgccgccctctgcccttgaaatgctggcaagtacgcagccccgcgatcgtcacgtgacgccggggttcagcgtatccttgctgggcaaccgtcttagagaccagcactgctggctgcaccatgaatgtgatctacccactggcagtccccaaggggcgcagactctgctgtgaggtgtgcgaagccccagccgagcgggtgtgcgcggcctgcacagtcacttattactgtggggtggtacatcagaaggctgactgggacagcatccatgagaaaatatgtcagctcttgattccactgcgcacttccatgcccttctacaattcagaggaagaacggcagcatggcctgcagcagctgcagcagcggcagaagtatttgattgaattctgctacaccatagcccagaaatacctctttgaagggaaacacgaagatgctgtaccagcagctttgcagtcccttcgcttccgtgtgaagctgtatggcctgagctccgtagagcttgtgcctgcttacctgctgttggccgaggccagccttggtctgggccgaatcgttcaggctgaagaatatctattccaagcccagtggacagtcctcaaatcaactgactgtagtaatgccacccactctttactgcatcggaatctgggacttctctatatagctaagaaaaactatgaagaggcccgttatcatctggccaatgatatttattttgccagttgtgcatttggaacagaggacattaggacttcaggaggctacttccacctggctaatatattctatgaccttaaaaagttggacctggcagacacattgtacaccaaggtctctgagatctggcatgcatatttgaacaatcactatcaagtcctctcacaggctcacatccaacaaatggatttactgggcaaactatttgagaatgacactggcttggatgaagcccaagaagcagaagccattcgcatcctgacttcaatcttgaacattcgagaatctacatctgacaaagccccccaaaaaaccatctttgttctgaagatcctggtcatgttttactacctgatgatgaattcttcaaaggcacaggaatatggcatgagggccctcagtctagccaaagaacaacagcttgatgtccatgagcaaagcaccattcaagagttattaagtctcatttcaactgaagaccatcccattacttagtgacccatgagctctgcatcaagggttattccaggggctactgaagatctaatatattccagccttgcacaactgctttgaggtactgtagactgctgaagtttccaccctcttcccctgggattgcacacatagctgttatttttttcttacacagcatattaagggaatataaagctttaggcatagaaatcactaaaaactgtgtttgtcatgacctttgtacttgatttatcatgactttgtatgactgagtaatatgtagtcagatcactaatatggtatttgtaattaaactacaaatagtttgtcatttcccagaagtcttccaacgatgcatgtttcatacacttttgctaaaggaggggtaaaggagggggtagggaataaagctatattggaacaaa

SEQ ID NO: 204660 - DNA, 1503 bp, Homo sapiens
  Payload ID: 20369
  Gene Name: zinc finger, MYND-type containing 12
  ENST ID: ENST00000611861
  CDS Start-End: 257-634
tctggacttggactccttgggagtcgtttctcggccatttgacccgtgggacttgtgggttttgtgctgctttttctttctttcttccccttttccaacttcagcaatacacccagatgttagtcgagtcacgtcccgccgccctctgcccttgaaatgctggcaagtacgcagccccgcgatcgtcacgtgacgccggggttcagcgtatccttgctgggcaaccgtcttagagaccagcactgctggctgcaccatgaatgtgatctacccactggcagtccccaaggggcgcagactctgctgtgaggtgtgcgaagccccagccgagcgggtgtgcgcggcctgcacagtcacttattactgtggggtggtacatcagaaggctgactgggacagcatccatgagaaaatatgtcagctcttgattccactgcgcacttccatgcccttctacaattcagaggaagaacggcagcatggcctgcagcagctgcagcagcggcaggtctgggccgaatcgttcaggctgaagaatatctattccaagcccagtggacagtcctcaaatcaactgactgtagtaatgccacccactctttactgcatcggaatctgggacttctctatatagctaagaaaaactatgaagaggcccgttatcatctggccaatgatatttattttgccagttgtgcatttggaacagaggacattaggacttcaggaggctacttccacctggctaatatattctatgaccttaaaaagttggacctggcagacacattgtacaccaaggtctctgagatctggcatgcatatttgaacaatcactatcaagtcctctcacaggctcacatccaacaaatggatttactgggcaaactatttgagaatgacactggcttggatgaagcccaagaagcagaagccattcgcatcctgacttcaatcttgaacattcgagaatctacatctgacaaagccccccaaaaaaccatctttgttctgaagatcctggtcatgttttactacctgatgatgaattcttcaaaggcacaggaatatggcatgagggccctcagtctagccaaagaacaacagcttgatgtccatgagcaaagcaccattcaagagttattaagtctcatttcaactgaagaccatcccattacttagtgacccatgagctctgcatcaagggttattccaggggctactgaagatctaatatattccagccttgcacaactgctttgaggtactgtagactgctgaagtttccaccctcttcccctgggattgcacacatagctgttatttttttcttacacagcatattaagggaatataaagctttaggcatagaaatcactaaaaactgtgtttgtcatgacctttgtacttgatttatcatgactttgtatgactgagtaatatgtagtcagatcactaatatggtatttgtaattaaactacaaatagtttgtcatttcccag

SEQ ID NO: 204661 - DNA, 417 bp, Homo sapiens
  Payload ID: 20369
  Gene Name: zinc finger, MYND-type containing 12
  ENST ID: ENST00000461083
  CDS Start-End: 15-149
ctgctggctgcaccatgaatgtgatctacccactggcagtccccaaggggcgcagactctgctgtgaggtgtgcgaagccccagccgagcgggtgtgcgcggcctgcacagtcacttattactggtctgggccgaatcgttcaggctgaagaatatctattccaagcccagtggacagtcctcaaatcaactgactgtagtaatgccacccactctttactgcatcggaatctgggacttctctatatagctaagaaaaactatgaagaggcccgttatcatctggccaatgatatttattttgccagttgtgcatttggaacagaggacattaggacttcaggaggctacttccacctggctaatatattctatgaccttaaaaagttggacctggcagacacattgtacaccaag

SEQ ID NO: 204662 - DNA, 2448 bp, Homo sapiens
  Payload ID: 20370
  Gene Name: zinc finger, MYND-type containing 15
  Uniprot ID: Q9H091
  ENST ID: ENST00000269289
  CDS Start-End: 67-2319
gaggtatttaccttcgaaaagtggtggcggctgcagtctgggccggggccctgtgccgctgaagacatggagtttgtgtctggataccgggatgagttccttgatttcactgcccttctcttcggctggttccgaaagtttgtggcagagcgtggagctgtagggactagccttgagggccgctgccggcagctggaggcccagatcagaaggctaccccaggaccctgccctttgggtgctccatgtcctgcccaaccatagtgtgggcatcagcctggggcaaggggcagaaccaggtcctggaccaggcctggggactgcctggctcctgggagacaaccctccactccacctgcgagacctgagcccctacatcagctttgtcagcctagaggatggggaggaaggggaggaggaagaggaggaagatgaagaagaagagaagagagaggacgggggtgcaggcagcacagagaaggtggaaccagaggaggaccgggagctagcccctaccagcagggagtccccccaggaaacaaaccctccaggagagtcagaggaggctgcccgggaggcaggaggtggcaaggatggctgccgagaggacagggtggagaacgaaacaagaccccagaagaggaagggacagaggagtgaggctgcccccctgcacgtttcctgtctcttacttgtgacggatgagcatggcaccatcttgggcattgatctgctagtggatggagcccagggaaccgcaagctggggctcagggaccaaggacctggctccttgggcctatgctctcctctgtcacagcatggcctgtcccatgggctctggggatccccgaaagccccgacagcttactgtgggagatgcccggctgcatcgagagctggagagcttggtcccaaggctaggtgtgaagttagccaaaaccccaatgcggacatggggtccccggccaggcttcacctttgcttcccttcgtgctcgaacctgccatgtgtgtcacaggcacagctttgaagcgaagctgacaccttgcccccagtgtagtgctgtcttgtattgtggagaggcttgtctccgggctgactggcagcggtgcccagatgatgtgagtcaccgattttggtgcccaaggcttgcagccttcatggagcgggcaggagaactggcaaccctgccttttacctacaccgcagaggtgaccagtgaaaccttcaacaaagaggccttcctggcctctcggggcctcactcgtggctattggacccagctcagcatgctgattccaggcccgggcttctccagacacccccgaggcaacacgccatccctcagccttcttcgcggtggagacccctaccagcttctccagggagacgggactgccctgatgcctcctgtgcccccacatccaccccggggtgtttttggctcatggcaggattactacacatggcggggcctcagcttggactcccccatagccgtgcttctcacctacccgctgaccgtgtactacgtcatcacccacctggtgccccagtccttccctgagctcaacatccaaaacaaacagtcactgaagatccacgtggtggaggccgggaaggagtttgaccttgtcatggtgttttgggagcttttggtcctgctcccccatgtggccctggagctgcagtttgtaggtgatggcctgccccccgaaagcgacgagcagcattttaccctgcagagggacagcctggaggtgtctgtccggcctggttccggcatatcagcacggcccagctctggcactaaggagaaagggggccgcagggacctgcagatcaaggtgtcagcaaggccctaccacctgttccaggggcccaagcctgacctggttattgcttctccctcctctctgtctgcaggatttaactccgggtttgctctcaaggatacgtggctgaggtctctgccccggttacagtccctccgagtgccagccttcttcaccgagagcagcgagtacagctgtgtgatggacggccagaccatggcggtggccactggagggggcaccagccctccccagcccaaccccttccgctccccctttcgcctcagagcggccgacaactgcatgtcctggtactgcaatgccttcatcttccacctggtttacaagcctgctcaagggagcggggcccgcccggcgcccgggcccccacccccatccccaactccctctgctcctcctgcccccacccgaaggcgccgaggagaaaagaaacctgggcggggggcccgccggcggaaatgaatgctgataccctagtagtccccagctcccaaacactgaaaggaaaacgtgaaaacactcaaggcctagggggaggacaggttggtaaaacatgaaaaggtaaataaaattacttgtttgaaaccactg

SEQ ID NO: 204663 - DNA, 2411 bp, Homo sapiens
  Payload ID: 20370
  Gene Name: zinc finger, MYND-type containing 15
  Uniprot ID: Q9H091
  ENST ID: ENST00000433935
  CDS Start-End: 58-2286
accttcgaaaagtggtggcggctgcagtctgggccggggccctgtgccgctgaagacatggagtttgtgtctggataccgggatgagttccttgatttcactgcccttctcttcggctggttccgaaagtttgtggcagagcgtggagctgtagggactagccttgagggccgctgccggcagctggaggcccagatcagaaggctaccccaggaccctgccctttgggtgctccatgtcctgcccaaccatagtgtgggcatcagcctggggcaaggggcagaaccaggtcctggaccaggcctggggactgcctggctcctgggagacaaccctccactccacctgcgagacctgagcccctacatcagctttgtcagcctagaggatggggaggaaggggaggaggaagaggaggaagatgaagaagaagagaagagagaggacgggggtgcaggcagcacagagaaggtggaaccagaggaggaccgggagctagcccctaccagcagggagtccccccaggaaacaaaccctccaggagagtcagaggaggctgcccgggaggcaggaggtggcaaggatggctgccgagaggacagggtggagaacgaaacaagaccccagaagaggaagggacagaggagtgaggctgcccccctgcacgtttcctgtctcttacttgtgacggatgagcatggcaccatcttgggcattgatctgctagtggatggagcccagggaaccgcaagctggggctcagggaccaaggacctggctccttgggcctatgctctcctctgtcacagcatggcctgtcccatgggctctggggatccccgaaagccccgacagcttactgtgggagatgcccggctgcatcgagagctggagagcttggtcccaaggctaggtgtgaagttagccaaaaccccaatgcggacatggggtccccggccaggcttcacctttgcttcccttcgtgctcgaacctgccatgtgtgtcacaggcacagctttgaagcgaagctgacaccttgcccccagtgtagtgctgtcttgtattgtggagaggcttgtctccgggctgactggcagcggtgcccagatgatgtgagtcaccgattttggtgcccaaggcttgcagccttcatggagcgggcaggagaactggcaaccctgccttttacctacaccgcagaggtgaccagtgaaaccttcaacaaagaggccttcctggcctctcggggcctcactcgtggctattggacccagctcagcatgctgattccaggcccgggcttctccagacacccccgaggcaacacgccatccctcagccttcttcgcggtggagacccctaccagcttctccagggagacgggactgccctgatgcctcctgtgcccccacatccaccccggggtgtttttggctcatggcaggattactacacatggcggggcctcagcttggactcccccatagccgtgcttctcacctacccgctgaccgtgtactacgtcatcacccacctggtgccccagtccttccctgagctcaacatccaaaacaaacagtcactgaagatccacgtggtggaggccgggaaggagtttgaccttgtcatggtgttttgggagcttttggtcctgctcccccatgtggccctggagctgcagtttgtaggtgatggcctgccccccgaaagcgacgagcagcattttaccctgcagagggacagcctggaggtgtctgtccggcctggttccggcatatcagcacggcccagctctggcactaaggagaaagggggccgcagggacctgcagatcaaggtgtcagcaaggccctaccacctgttccaggggcccaagcctgacctggttattggatttaactccgggtttgctctcaaggatacgtggctgaggtctctgccccggttacagtccctccgagtgccagccttcttcaccgagagcagcgagtacagctgtgtgatggacggccagaccatggcggtggccactggagggggcaccagccctccccagcccaaccccttccgctccccctttcgcctcagagcggccgacaactgcatgtcctggtactgcaatgccttcatcttccacctggtttacaagcctgctcaagggagcggggcccgcccggcgcccgggcccccacccccatccccaactccctctgctcctcctgcccccacccgaaggcgccgaggagaaaagaaacctgggcggggggcccgccggcggaaatgaatgctgataccctagtagtccccagctcccaaacactgaaaggaaaacgtgaaaacactcaaggcctagggggaggacaggttggtaaaacatgaaaaggtaaataaaattacttgtttgaaacc

SEQ ID NO: 204664 - DNA, 2409 bp, Homo sapiens
  Payload ID: 20370
  Gene Name: zinc finger, MYND-type containing 15
  Uniprot ID: Q9H091
  ENST ID: ENST00000573751
  CDS Start-End: 31-2283
tctgggccggggccctgtgccgctgaagacatggagtttgtgtctggataccgggatgagttccttgatttcactgcccttctcttcggctggttccgaaagtttgtggcagagcgtggagctgtagggactagccttgagggccgctgccggcagctggaggcccagatcagaaggctaccccaggaccctgccctttgggtgctccatgtcctgcccaaccatagtgtgggcatcagcctggggcaaggggcagaaccaggtcctggaccaggcctggggactgcctggctcctgggagacaaccctccactccacctgcgagacctgagcccctacatcagctttgtcagcctagaggatggggaggaaggggaggaggaagaggaggaagatgaagaagaagagaagagagaggacgggggtgcaggcagcacagagaaggtggaaccagaggaggaccgggagctagcccctaccagcagggagtccccccaggaaacaaaccctccaggagagtcagaggaggctgcccgggaggcaggaggtggcaaggatggctgccgagaggacagggtggagaacgaaacaagaccccagaagaggaagggacagaggagtgaggctgcccccctgcacgtttcctgtctcttacttgtgacggatgagcatggcaccatcttgggcattgatctgctagtggatggagcccagggaaccgcaagctggggctcagggaccaaggacctggctccttgggcctatgctctcctctgtcacagcatggcctgtcccatgggctctggggatccccgaaagccccgacagcttactgtgggagatgcccggctgcatcgagagctggagagcttggtcccaaggctaggtgtgaagttagccaaaaccccaatgcggacatggggtccccggccaggcttcacctttgcttcccttcgtgctcgaacctgccatgtgtgtcacaggcacagctttgaagcgaagctgacaccttgcccccagtgtagtgctgtcttgtattgtggagaggcttgtctccgggctgactggcagcggtgcccagatgatgtgagtcaccgattttggtgcccaaggcttgcagccttcatggagcgggcaggagaactggcaaccctgccttttacctacaccgcagaggtgaccagtgaaaccttcaacaaagaggccttcctggcctctcggggcctcactcgtggctattggacccagctcagcatgctgattccaggcccgggcttctccagacacccccgaggcaacacgccatccctcagccttcttcgcggtggagacccctaccagcttctccagggagacgggactgccctgatgcctcctgtgcccccacatccaccccggggtgtttttggctcatggcaggattactacacatggcggggcctcagcttggactcccccatagccgtgcttctcacctacccgctgaccgtgtactacgtcatcacccacctggtgccccagtccttccctgagctcaacatccaaaacaaacagtcactgaagatccacgtggtggaggccgggaaggagtttgaccttgtcatggtgttttgggagcttttggtcctgctcccccatgtggccctggagctgcagtttgtaggtgatggcctgccccccgaaagcgacgagcagcattttaccctgcagagggacagcctggaggtgtctgtccggcctggttccggcatatcagcacggcccagctctggcactaaggagaaagggggccgcagggacctgcagatcaaggtgtcagcaaggccctaccacctgttccaggggcccaagcctgacctggttattgcttctccctcctctctgtctgcaggatttaactccgggtttgctctcaaggatacgtggctgaggtctctgccccggttacagtccctccgagtgccagccttcttcaccgagagcagcgagtacagctgtgtgatggacggccagaccatggcggtggccactggagggggcaccagccctccccagcccaaccccttccgctccccctttcgcctcagagcggccgacaactgcatgtcctggtactgcaatgccttcatcttccacctggtttacaagcctgctcaagggagcggggcccgcccggcgcccgggcccccacccccatccccaactccctctgctcctcctgcccccacccgaaggcgccgaggagaaaagaaacctgggcggggggcccgccggcggaaatgaatgctgataccctagtagtccccagctcccaaacactgaaaggaaaacgtgaaaacactcaaggcctagggggaggacaggttggtaaaacatgaaaaggtaaataaaattacttgtttgaaacca

SEQ ID NO: 204665 - DNA, 2274 bp, Homo sapiens
  Payload ID: 20370
  Gene Name: zinc finger, MYND-type containing 15
  Uniprot ID: Q9H091
  ENST ID: ENST00000592813
  CDS Start-End: 40-2151
cggctgcagtctgggccggggccctgtgccgctgaagacatggagtttgtgtctggataccgggatgagttccttgatttcactgcccttctcttcggctggttccgaaagtttgtggcagagcgtggagctgtagggactagccttgagggccgctgccggcagctggaggcccagatcagaaggctaccccaggaccctgccctttgggtgctccatgtcctgcccaaccatagtgtgggcatcagcctggggcaaggggcagaaccaggtcctggaccaggcctggggactgcctggctcctgggagacaaccctccactccacctgcgagacctgagcccctacatcagctttgtcagcctagaggatggggaggaaggggaggaggaagaggaggaagatgaagaagaagagaagagagaggacgggggtgcaggcagcacagagaaggtggaaccagaggaggaccgggagctagcccctaccagcagggagtccccccaggaaacaaaccctccaggagagtcagaggaggctgcccgggaggcaggaggtggcaaggatggctgccgagaggacagggtggagaacgaaacaagaccccagaagaggaagggacagaggagtgaggctgcccccctgcacgtttcctgtctcttacttgtgacggatgagcatggcaccatcttgggcattgatctgctagtggatggagcccagggaaccgcaagctggggctcagggaccaaggacctggctccttgggcctatgctctcctctgtcacagcatggcctgtcccatgggctctggggatccccgaaagccccgacagcttactgtgggagatgcccggctgcatcgagagctggagagcttggtcccaaggctaggtgtgaagttagccaaaaccccaatgcggacatggggtccccggccaggcttcacctttgcttcccttcgtgctcgaacctgccatgtgtgtcacaggcacagctttgaagcgaagctgacaccttgcccccagtgtagtgctgtcttgtattgtggagaggcttgtctccgggctgactggcagcggtgcccagatgatgtgagtcaccgattttggtgcccaaggcttgcagccttcatggagcgggcaggagaactggcaaccctgccttttacctacaccgcagaggtgaccagtgaaaccttcaacaaagaggccttcctggcctctcggggcctcactcgtggctattggacccagctcagcatgctgattccaggcccgggcttctccagacacccccgaggcaacacgccatccctcagccttcttcgcggtggagacccctaccagcttctccagggagacgggactgccctgatgcctcctgtgcccccacatccaccccggggtgtttttgtccctgagctcaacatccaaaacaaacagtcactgaagatccacgtggtggaggccgggaaggagtttgaccttgtcatggtgttttgggagcttttggtcctgctcccccatgtggccctggagctgcagtttgtaggtgatggcctgccccccgaaagcgacgagcagcattttaccctgcagagggacagcctggaggtgtctgtccggcctggttccggcatatcagcacggcccagctctggcactaaggagaaagggggccgcagggacctgcagatcaaggtgtcagcaaggccctaccacctgttccaggggcccaagcctgacctggttattggatttaactccgggtttgctctcaaggatacgtggctgaggtctctgccccggttacagtccctccgagtgccagccttcttcaccgagagcagcgagtacagctgtgtgatggacggccagaccatggcggtggccactggagggggcaccagccctccccagcccaaccccttccgctccccctttcgcctcagagcggccgacaactgcatgtcctggtactgcaatgccttcatcttccacctggtttacaagcctgctcaagggagcggggcccgcccggcgcccgggcccccacccccatccccaactccctctgctcctcctgcccccacccgaaggcgccgaggagaaaagaaacctgggcggggggcccgccggcggaaatgaatgctgataccctagtagtccccagctcccaaacactgaaaggaaaacgtgaaaacactcaaggcctagggggaggacaggttggtaaaacatgaaaaggtaaataaaattacttgtttgaaa

SEQ ID NO: 204666 - DNA, 1375 bp, Homo sapiens
  Payload ID: 20371
  Gene Name: zinc finger, MYND-type containing 19
  Uniprot ID: Q96E35
  ENST ID: ENST00000298585
  CDS Start-End: 228-911
cggtggcggtggcggcggcggcggcggcgcgtggcaggtccggcgggcgcgaggcggcggcggaggcccgagcccggcccagcctcgtcccgcccggagcccgcctggctgctaccccgaccccggctccggtcccgtcctgtcccggcgcgccgcggcctcgccccggcccccgctcggcgcctcccgagggagcggcgctgccggccgagagcgcaggcccggccatgaccgacttcaaattgggtatcgtgcggctcggccgggtggccgggaagaccaaatacacgctgatcgatgagcaggacatcccgctggtggagagctactcctttgaggcccgaatggaagtggatgcagatggaaatggtgctaagatatttgcctatgcctttgacaagaaccgaggaaggggctctgggagactccttcatgagctgctgtgggagcggcaccgggggggcgtggccccgggcttccaggtggtgcacctcaacgctgtgaccgtggacaatcgcctggacaacctgcaactggtgccgtggggctggcggcccaaggctgaagagacctccagcaagcagagggagcaaagcttgtattggcttgcaattcagcagctgcctacagaccctatagaagaacagtttcctgtcctaaatgtgacccggtattataatgccaacggggatgtagtggaagaggaggagaactcttgcacctactatgagtgccactaccctccctgcacagtgattgagaagcagctccgggagttcaacatctgtgggcgctgccaggtggcccggtactgcggctcccagtgccagcagaaggactggcctgcccacaagaagcactgtcgggagaggaagcgtcccttccagcatgagcttgagccagagcgatgacgggcaggggagccacacatactcacagcccccgggctctaccctgggcacagcagagacagactggtggttgaacctggaggtgccaaaaaagccagctgcgggcccaggacagctgccgtgagactcccgatgtcacaggcagtctgtgtggttacagcgcccctcagtgttcatctccagcagagacaacggaggaggctcccaccaggacggttctcattatttatatgttaatatgtttgtaaactcatgtacagttttttttgggggggaggcaatgggaagggtagaaattacaaatagaatcatttgctgtaatccttaaatggcaaacggtcaggccacgtgactaaaaactgtcctgttgtcgaagcttctcccctgggccgccgggagccccgtggagcgcggcctgcacgggagttgtgtccacaaaggcaaagtaaaggggtggaatcatc

SEQ ID NO: 204667 - DNA, 4139 bp, Homo sapiens
  Payload ID: 20372
  Gene Name: zinc finger, MYND-type containing 8
  Uniprot ID: Q9ULU4
  ENST ID: ENST00000262975
  CDS Start-End: 285-3791
cggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagtcccaaatctgccagcctgttctctcttcctaactgtggaaaaatgagacggttgcttgaacatttgttggcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgatttaaaaaaaaaaaaaaaa

SEQ ID NO: 204668 - DNA, 5362 bp, Homo sapiens
  Payload ID: 20372
  Gene Name: zinc finger, MYND-type containing 8
  Uniprot ID: Q9ULU4
  ENST ID: ENST00000311275
  CDS Start-End: 255-3815
ggagtgtagaggaaataaaatcatgtctgtggctcatgacagcattccatattcagttgttgggttgtgttgttgttgttgtgtgtgtttttaataataccatgtaactgtttaaaaaaatttcctttttgatcaagtcccaaatctgccagcctgttctctcttcctaactgtggaaaaatgagacggttgcttgaacatttgttggcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaagctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaaatagcctagctggccttatttgtgaagcataattgcttttagcatatggaagtattttttcacattttctttgtataaaatttgtattaaacttaaatatctttttgatggtggtgtttctttgtgactgagccagtagactcacactatatgcttttttgggtttgcccgttccttcccccacccccccagttttttcagatttctttacctttttttaattaaactgttttggaaaaatgc

SEQ ID NO: 204669 - DNA, 3832 bp, Homo sapiens
  Payload ID: 20372
  Gene Name: zinc finger, MYND-type containing 8
  Uniprot ID: Q9ULU4
  ENST ID: ENST00000352431
  CDS Start-End: 30-3512
ataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaa

SEQ ID NO: 204670 - DNA, 5542 bp, Homo sapiens
  Payload ID: 20372
  Gene Name: zinc finger, MYND-type containing 8
  Uniprot ID: Q9ULU4
  ENST ID: ENST00000355972
  CDS Start-End: 351-3995
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagtcccaaatctgccagcctgttctctcttcctaactgtggaaaaatgagacggttgcttgaacatttgttggcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaagctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaaatagcctagctggccttatttgtgaagcataattgcttttagcatatggaagtattttttcacattttctttgtataaaatttgtattaaacttaaatatctttttgatggtggtgtttctttgtgactgagccagtagactcacactatatgcttttttgggtttgcccgttccttcccccacccccccagttttttcagatttctttacctttttttaattaaactgttttggaaaaatgc

SEQ ID NO: 204671 - DNA, 4991 bp, Homo sapiens
  Payload ID: 20372
  Gene Name: zinc finger, MYND-type containing 8
  Uniprot ID: Q9ULU4
  ENST ID: ENST00000360911
  CDS Start-End: 37-3444
atgttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaaatagcctagctggccttatttgtgaagcataattgcttttagcatatggaagtattttttcacattttctttgtataaaatttgtattaaacttaaatatctttttgatggtggtgtttctttgtgactgagccagtagactcacactatatgcttttttgggtttgcccgttccttcccccacccccccagttttttcagatttctttacctttttttaattaaactgttttggaaaaatgc

SEQ ID NO: 204672 - DNA, 5144 bp, Homo sapiens
  Payload ID: 20372
  Gene Name: zinc finger, MYND-type containing 8
  Uniprot ID: Q9ULU4
  ENST ID: ENST00000372023
  CDS Start-End: 280-3597
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaaatagcctagctggccttatttgtgaagcataattgcttttagcatatggaagtattttttcacattttctttgtataaaatttgtattaaacttaaatatctttttgatggtggtgtttctttgtgactgagccagtagactcacactatatgcttttttgggtttgcccgttccttcccccacccccccagttttttcagatttctttacctttttttaattaaactgttttggaaaaatgc

SEQ ID NO: 204673 - DNA, 5511 bp, Homo sapiens
  Payload ID: 20372
  Gene Name: zinc finger, MYND-type containing 8
  Uniprot ID: Q9ULU4
  ENST ID: ENST00000396281
  CDS Start-End: 404-3964
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagtcccaaatctgccagcctgttctctcttcctaactgtggaaaaatgagacggttgcttgaacatttgttggcagcattcctgcctgaagtattcagctcctctaggctgttacaagccaaataatggttcccttgaatgcagccttcctccatgatcaatacacctttgaatgttttcatcgctgcagaaatccttcaacttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaagctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaaatagcctagctggccttatttgtgaagcataattgcttttagcatatggaagtattttttcacattttctttgtataaaatttgtattaaacttaaatatctttttgatggtggtgtttctttgtgactgagccagtagactcacactatatgcttttttgggtttgcccgttccttcccccacccccccagttttttcagatttctttacctttttttaattaaactgttttggaaaaatgc

SEQ ID NO: 204674 - DNA, 3729 bp, Homo sapiens
  Payload ID: 20372
  Gene Name: zinc finger, MYND-type containing 8
  Uniprot ID: Q9ULU4
  ENST ID: ENST00000458360
  CDS Start-End: 51-3215
ggagcctgtcctccatgttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtg

SEQ ID NO: 204675 - DNA, 175 bp, Homo sapiens
  Payload ID: 20372
  Gene Name: zinc finger, MYND-type containing 8
  ENST ID: ENST00000441977
  CDS Start-End: 103-175
atcaggtgtgggtttcctcccccagccctggataaggatgagggaatgtctttaagcttggctgaagaggaaataaaaacagaacaggaggtggtagagggcatggatatctctactcgctccaaagatcctggctctgcagagagaacagcccagaaaagaaagttccccagcc

SEQ ID NO: 204676 - DNA, 341 bp, Homo sapiens
  Payload ID: 20372
  Gene Name: zinc finger, MYND-type containing 8
  ENST ID: ENST00000446894
  CDS Start-End: 215-341
tttaggaaggtggctttgaaactcgcagggctgcttaaacaagagctacagctattgaacaaactgctaccattttagcttcaacacaggaatgaggcagtgttgccagacgccattttaagaatcctgcataaatagcttagctaccgatgactctgcctgttttagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccatta

SEQ ID NO: 204677 - DNA, 5471 bp, Homo sapiens
  Payload ID: 20372
  Gene Name: zinc finger, MYND-type containing 8
  Uniprot ID: Q9ULU4
  ENST ID: ENST00000446994
  CDS Start-End: 280-3924
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaagctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaaatagcctagctggccttatttgtgaagcataattgcttttagcatatggaagtattttttcacattttctttgtataaaatttgtattaaacttaaatatctttttgatggtggtgtttctttgtgactgagccagtagactcacactatatgcttttttgggtttgcccgttccttcccccacccccccagttttttcagatttctttacctttttttaattaaactgttttggaaaaatgc

SEQ ID NO: 204678 - DNA, 670 bp, Homo sapiens
  Payload ID: 20372
  Gene Name: zinc finger, MYND-type containing 8
  ENST ID: ENST00000435836
  CDS Start-End: 146-670
acacagtgttaacaatgcatccacagagtcccaaatctgccagcctgttctctcttcctaactgtggaaaaatgagacggttgcttgaacatttgttggcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaag

SEQ ID NO: 204679 - DNA, 3567 bp, Homo sapiens
  Payload ID: 20372
  Gene Name: zinc finger, MYND-type containing 8
  Uniprot ID: Q9ULU4
  ENST ID: ENST00000461685
  CDS Start-End: 1-3567
atgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactag

SEQ ID NO: 204680 - DNA, 3634 bp, Homo sapiens
  Payload ID: 20372
  Gene Name: zinc finger, MYND-type containing 8
  ENST ID: ENST00000467200
  CDS Start-End: 1-3286
cacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgatttaaaaaaaaaaaaaaaa

SEQ ID NO: 204681 - DNA, 4053 bp, Homo sapiens
  Payload ID: 20372
  Gene Name: zinc finger, MYND-type containing 8
  Uniprot ID: Q9ULU4
  ENST ID: ENST00000471951
  CDS Start-End: 28-3732
aagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaagctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaag

SEQ ID NO: 204682 - DNA, 5273 bp, Homo sapiens
  Payload ID: 20372
  Gene Name: zinc finger, MYND-type containing 8
  Uniprot ID: Q9ULU4
  ENST ID: ENST00000536340
  CDS Start-End: 1-3726
atggtgtttctggaagagtttgaagctagatcctgcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaagctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaaatagcctagctggccttatttgtgaagcataattgcttttagcatatggaagtattttttcacattttctttgtataaaatttgtattaaacttaaatatctttttgatggtggtgtttctttgtgactgagccagtagactcacactatatgcttttttgggtttgcccgttccttcccccacccccccagttttttcagatttctttacctttttttaattaaactgttttggaaaaatgc

SEQ ID NO: 204683 - DNA, 3405 bp, Homo sapiens
  Payload ID: 20372
  Gene Name: zinc finger, MYND-type containing 8
  Uniprot ID: Q9ULU4
  ENST ID: ENST00000540497
  CDS Start-End: 1-3405
atgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaagctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactag

SEQ ID NO: 204684 - DNA, 4027 bp, Homo sapiens
  Payload ID: 20372
  Gene Name: zinc finger, MYND-type containing 8
  ENST ID: ENST00000619049
  CDS Start-End: 280-2583
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaaatagcctagctggccttatttgtgaagcataattgcttttagcatatggaagtattttttcacattttctttgtataaaatttgtattaaacttaaatatctttttgatggtggtgtttctttgtgactgagccagtagactcacactatatgcttttttgggtttgcccgttccttcccccacccccccagttttttcagatttctttacctttttttaattaaactgttttggaaaaatgc

SEQ ID NO: 204685 - DNA, 3411 bp, Homo sapiens
  Payload ID: 20372
  Gene Name: zinc finger, MYND-type containing 8
  ENST ID: ENST00000617418
  CDS Start-End: 1-3411
atgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactag

SEQ ID NO: 204686 - DNA, 5090 bp, Homo sapiens
  Payload ID: 20372
  Gene Name: zinc finger, MYND-type containing 8
  ENST ID: ENST00000611941
  CDS Start-End: 280-3543
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaaatagcctagctggccttatttgtgaagcataattgcttttagcatatggaagtattttttcacattttctttgtataaaatttgtattaaacttaaatatctttttgatggtggtgtttctttgtgactgagccagtagactcacactatatgcttttttgggtttgcccgttccttcccccacccccccagttttttcagatttctttacctttttttaattaaactgttttggaaaaatgc

SEQ ID NO: 204687 - DNA, 2964 bp, Homo sapiens
  Payload ID: 20373
  Gene Name: zinc finger, NFX1-type containing 1
  ENST ID: ENST00000371744
  CDS Start-End: 161-2964
gaaaggacgcgccggagccgggtgagtggccccgcaactgcccctgcccctgattcttccttgcctcgccgcgaaccccggcgcccgcgccgacccgccactgcctctgcccttttccagataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatacgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagacccagcgcaaccagaaaaagaaaatgaaaaaaagagtgaaggatgagcttcgcaaactgaacaccatgactgcagccgaggccaacgagatcgaggatgtttggcagctggacctcagttctcgctggcagctttatag

SEQ ID NO: 204688 - DNA, 7212 bp, Homo sapiens
  Payload ID: 20373
  Gene Name: zinc finger, NFX1-type containing 1
  Uniprot ID: Q9P2E3
  ENST ID: ENST00000371752
  CDS Start-End: 86-5842
gccccagcactcgccggcggcagtgaaaggacgcgccggagccggataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatacgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagacccagcgcaaccagaaaaagaaaatgaaaaaaagagtgaaggatgagcttcgcaaactgaacaccatgactgcagccgaggccaacgagatcgaggatgtttggcagctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtgctgccaaataccgccagatcctacagaaggtggagccgaggattgtcatagtggaagaagctgcggaagtccttgaggcccataccattgccacattgagcaaagcttgccagcacctcattttgattggggaccaccagcagctgcgccccagtgccaacgtgtatgatctggccaagaacttcaaccttgaggtgtccctttttgaacggctagtgaaagtaaacattccctttgtccgtctgaattaccagcaccgtatgtgccctgaaattgcccgccttttgaccccccacatttaccaggatctggagaatcatccatctgttcttaagtatgagaagattaagggggtgtcttccaaccttttctttgtagaacacaactttcctgaacaggaaatccaagagggcaaaagccatcagaaccagcatgaggctcactttgtggtagagctgtgcaagtacttcctgtgccaggaatacctgccttcccagatcaccatcctcactacctataccgggcagctcttctgcctgcgcaaactgatgcctgccaagacatttgctggcgtcagggtccatgttgtggacaaataccaaggggaagagaatgacatcatcctcctctcgctagtgcggagcaaccaagaaggcaaggtgggttttctgcagatatccaaccgcatctgtgtggccttgtcccgagccaagaagggaatgtactgcatcggaaacatgcagatgctggccaaggtgcccctgtggagcaagatcattcatacacttcgagagaacaatcaaataggccccatgctccggctctgctgccagaaccaccctgaaacccacaccttagtatccaaagcttctgacttccaaaaagtacccgaaggaggctgcagcctgccctgcgagttccgcctgggctgtgggcatgtctgcacccgtgcctgccacccttatgactcttcacacaaggagttccaatgcatgaagccatgccagaaggtcatctgtcaggaagggcaccggtgtccccttgtttgcttccaggagtgtcagccttgtcaggtgaaggtgcccaaaaccattcctcggtgcggccatgaacaaatggtcccttgttccgtgcctgagtcagatttctgctgccaggagccttgctccaagtctctgagatgtgggcacagatgcagccacccatgtggtgaggactgtgtgcagctgtgttcagaaatggtcaccataaaactcaagtgtgggcacagtcaaccggtaaaatgtggtcatgtggaaggcctcctgtatggtggtctgctagtcaagtgtaccacaaagtgtggcactatcttggactgcgggcatccttgcccaggctcctgccacagctgcttcgaagggcgtttccatgaacgctgtcagcagccctgcaagcgcctgcttatctgctcacacaagtgccaggaaccatgcattggtgagtgcccaccctgccagcggacctgtcagaaccgctgtgtccacagccagtgcaagaagaaatgtggggagctgtgtagtccctgcgtggaaccctgtgtctggcgctgccagcactaccagtgcaccaaactctgctctgagccctgcaaccgacccccatgctatgtgccttgtactaagctgctagtttgtggccacccctgcattggtctctgtggggagccatgccccaagaaatgccggatctgccacatggatgaggtcacccaaatattctttggctttgaggatgagcctgatgcccgctttgtgcagctggaagactgcagccacatctttgaggtgcaagccctagaccgctacatgaatgaacagaaggatgatgaagtcgccatcagattgaaagtctgccctatctgccaggtgcccatccgcaaaaacctgaggtatggaactagcataaaacagcggctagaagagattgaaatcatcaaggaaaagatccagggctcagcaggggaaatagcaaccagccaggaacggcttaaggccctgctggagaggaagagcctcctccaccagctgcttcctgaagacttcctgatgttaaaggagaagctggcccagaaaaatctgtcagtgaaggacctgggtctggttgagaattacatcagcttctatgaccacctggccagcctgtgggattccctgaaaaagatgcatgtcttagaagagaaaagagtgaggactcgactagaacaggtccatgagtggctggccaagaagcgcttgagcttcactagccaggaactaagtgacctccgaagtgaaatccagaggctcacatacctggtgaaccttctgacccgctacaagatagcagagaagaaggtgaaagatagcatagcagtagaggtctatagtgtccagaatatccttgagaaaacatgtaagttcacccaagaggatgaacaacttgtgcaggaaaagatggaagctctgaaagccacccttccctgctctggcctgggcatctcagaggaagagcgagtgcagattgtcagtgccataggttatcctcgtggtcactggttcaagtgccgcaatggccatatctatgtgattggcgattgtgggggagccatggagaggggcacgtgtcctgactgtaaggaagtgattggtggcacaaatcatactctggaaagaagcaaccagcttgcttctgaaatggatggagcccagcatgctgcctggtctgacacggccaacaacctgatgaactttgaggagatccaggggatgatgtaggaagatggtacaccactgccttttgccctcgccactgaatgactggggccagctccctaatgaaggaactgaagtttgttttttattatcatcctttttaggctgggcgcagtggcttacgcctgtaatcccagcactttgggaggccgaggcaggcggatcacgaggtcaggagttcgagaccagcctgaccaacatggcgaaaccccgtctctactaaaaatacaaaaattagctgggcgttatggcgggcgcctgtaatcccagctacttgggaggctgaggcagaagaatcgcttaaacccaggaggcggaggttgcagtgagctgagatcatgccattgcactccagtctgggcgacaggagcaagactctgtctcaaaaaaaaaaaaatcattctttttagtcttagcacctacttaaggatccacttttagggctcacccacatttgtttctagatttacccctgcgctagagtaagcactttatctccagaactgagagcaaagttaacaaatctcaccccttctctcctgcaaattagtggacagactccctggaacatgtttggggcttccacctagggccacctagtggtatctctgggtctttacttggtcagatgtttattctacattgttccccaggaacagagtatgagctcattgatgcagaccgattctaattgccaggccctaatttgcagactaactctcataataaacagaggcccatagttgtttatgaactgcttatcccttaaaggagcacaagaacccctccctgccctccttgggcaccctgcctccaggagatggaggcacgtgataagacaaaagactgcaccaactcaccctgacacagttacatagtcactgagagtggggaagatgggacagcccacatgctgcataagatgggccttatgcagcaggcccaggtcgtcattaaggagtgacccctttcctgtaacctgcactttgggatggtagaagtttctttacctgctgacaggtttggtggcactgctggttacccctgggccctgaatggagctaaaatcacatttggtaccagcagcacctatcccaagtgtgatccttcatcccaacactccctcttggagctgttccctgggtagagctagcatgccagcagcttctgcaggctccaaacccaggccagaagccagacccaggcctgctgcctgcatctgcattccctccttccagtgttccttagaacagacatttaggtatctcaggtcctttctaagtgtccctttcctatgtatgcatttcctttttttgtctttactatgcactttagcttataaagccaattaaaaacaatgattgagaaaatca

SEQ ID NO: 204689 - DNA, 5235 bp, Homo sapiens
  Payload ID: 20373
  Gene Name: zinc finger, NFX1-type containing 1
  ENST ID: ENST00000371754
  CDS Start-End: 455-4267
ttcctcgccatgtcgcgcttcacacgcaccaaaccgctcgacgggttccccttcctctggggccggctgaggcccgcaaaggccttgggcgcagtcatctcccgccccccgcggtccgctcccctcagccgcgcccgcctgagcccgccggctccgccgccggggggagctgaggtgacgccctcctcgagggcggaggcgccggccgtgcctgggccaggccctcgtgctctccaccctgggcccccgcctcctccttctcctcctctgggccgcccgcccggctccgcccagggtctgcggggaacggaaaccgaaagtgcgcggcgccgggcggggccaccgacctgcctgggccgaagccccagcactcgccggcggcagtgaaaggacgcgccggagccggttttccagataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatacgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagacccagcgcaaccagaaaaagaaaatgaaaaaaagagtgaaggatgagcttcgcaaactgaacaccatgactgcagccgaggccaacgagatcgaggatgtttggcagctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtgctgccaaataccgccagatcctacagaaggtggagccgaggattgtcatagtggaagaagctgcggaagtccttgaggcccataccattgccacattgagcaaagcttgccagcacctcattttgattggggaccaccagcagctgcgccccagtgccaacgtgtatgatctggccaagaacttcaaccttgaggtgtccctttttgaacggctagtgaaagtaaacattccctttgtccgtctgaattaccagcaccgtatgtgccctgaaattgcccgccttttgaccccccacatttaccaggatctggagaatcatccatctgttcttaagtatgagaagattaaggccaagtcaaattcctgcagagctttggcaactgggatgagaagaaagcataagatttcagggatgattttatctttttttaagcttacgataagaagtgcacgttttcaattgctcctctcgggctcttggaccactgcctccttccccttctccaggagccgctttgctgtattgatctgtagagataacaaaaggatgcctgccgtgaaacccgtatctactaacacaggaagccacgggctgcaaatgcctggggctctgatgggagaaacatttcagaagggcagcaccagcagggatgcagcagcttgcttactgagcagccttgtgaacaagatcccgcctcgcagcctcacctgggcttctgactgctgcatctctttttcctccgcctctagctgcagaactgcatacacatctttctccattttctcaatcttgtcccggaatttgaggatgacatctcaatgggagaaaataaaaaggatttacaaataagggtaggccaggcatggtggctcacacctgtaacccggcactctgggagattgaggtgggaggattgcttgagcccaggaatttgaggccagcctgggcaacgtggccagactctgtctctacaaaaaaaaaaaaaaaaaaaaaaaaagccaggcacagtggctcatgcctgtaatcccacgctttgggaggccaaggcaggtggatcacctgaggtcaggagtttgagaccagcttggccaatgctgtgaaaccccgtctctattaaaaatacaaaaatcagctgggtgtgggggcacacgcctgtaatcccagctactactcagaaggctgaggcaggagaactgcttgaacccacgaggcggaggctgcagtaagccaagatgacaccactacactccagcctgggcaaaagagcgagactccatctaaaaaaaaaaaaaaaattagccatcatggtggcacacacctgtagtcccacctactcaggaggctgaggagaagaactgcttgaacccaggagttcgaggcaacagtaagctatgatcgcacccctgtaccccagcctgggcaacaaagcaagaccttatcttaaacaaaataaggcagtggctcaagcctgtaatcccagcactttgggaggccaaggcgggtggatcacgaggtcaagagatcgagaccatcctggacaacatggtgaaaccccacctgtactaaaaatataaaaattagctgggcgtggtggcatgcacctgtagtcccagctacttgggaggctgaggcaggaggatcacttgaacccgggacgcagaggttgcaatgggccgagatcgcaccactgcactccagcctggcaacagagcaagactccatctcaaaaataaattaaataaaataaaataagggtgactactaatactgtgtaactgatgaaaataatttagctgtgcatttactgacataggaaa

SEQ ID NO: 204690 - DNA, 7371 bp, Homo sapiens
  Payload ID: 20373
  Gene Name: zinc finger, NFX1-type containing 1
  Uniprot ID: Q9P2E3
  ENST ID: ENST00000396105
  CDS Start-End: 248-6004
gtgcctgggccaggccctcgtgctctccaccctgggcccccgcctcctccttctcctcctctgggccgcccgcccggctccgcccagggtctgcggggaacggaaaccgaaagtgcgcggcgccgggcggggccaccgacctgcctgggccgaagccccagcactcgccggcggcagtgaaaggacgcgccggagccggttttccagataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatacgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagacccagcgcaaccagaaaaagaaaatgaaaaaaagagtgaaggatgagcttcgcaaactgaacaccatgactgcagccgaggccaacgagatcgaggatgtttggcagctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtgctgccaaataccgccagatcctacagaaggtggagccgaggattgtcatagtggaagaagctgcggaagtccttgaggcccataccattgccacattgagcaaagcttgccagcacctcattttgattggggaccaccagcagctgcgccccagtgccaacgtgtatgatctggccaagaacttcaaccttgaggtgtccctttttgaacggctagtgaaagtaaacattccctttgtccgtctgaattaccagcaccgtatgtgccctgaaattgcccgccttttgaccccccacatttaccaggatctggagaatcatccatctgttcttaagtatgagaagattaagggggtgtcttccaaccttttctttgtagaacacaactttcctgaacaggaaatccaagagggcaaaagccatcagaaccagcatgaggctcactttgtggtagagctgtgcaagtacttcctgtgccaggaatacctgccttcccagatcaccatcctcactacctataccgggcagctcttctgcctgcgcaaactgatgcctgccaagacatttgctggcgtcagggtccatgttgtggacaaataccaaggggaagagaatgacatcatcctcctctcgctagtgcggagcaaccaagaaggcaaggtgggttttctgcagatatccaaccgcatctgtgtggccttgtcccgagccaagaagggaatgtactgcatcggaaacatgcagatgctggccaaggtgcccctgtggagcaagatcattcatacacttcgagagaacaatcaaataggccccatgctccggctctgctgccagaaccaccctgaaacccacaccttagtatccaaagcttctgacttccaaaaagtacccgaaggaggctgcagcctgccctgcgagttccgcctgggctgtgggcatgtctgcacccgtgcctgccacccttatgactcttcacacaaggagttccaatgcatgaagccatgccagaaggtcatctgtcaggaagggcaccggtgtccccttgtttgcttccaggagtgtcagccttgtcaggtgaaggtgcccaaaaccattcctcggtgcggccatgaacaaatggtcccttgttccgtgcctgagtcagatttctgctgccaggagccttgctccaagtctctgagatgtgggcacagatgcagccacccatgtggtgaggactgtgtgcagctgtgttcagaaatggtcaccataaaactcaagtgtgggcacagtcaaccggtaaaatgtggtcatgtggaaggcctcctgtatggtggtctgctagtcaagtgtaccacaaagtgtggcactatcttggactgcgggcatccttgcccaggctcctgccacagctgcttcgaagggcgtttccatgaacgctgtcagcagccctgcaagcgcctgcttatctgctcacacaagtgccaggaaccatgcattggtgagtgcccaccctgccagcggacctgtcagaaccgctgtgtccacagccagtgcaagaagaaatgtggggagctgtgtagtccctgcgtggaaccctgtgtctggcgctgccagcactaccagtgcaccaaactctgctctgagccctgcaaccgacccccatgctatgtgccttgtactaagctgctagtttgtggccacccctgcattggtctctgtggggagccatgccccaagaaatgccggatctgccacatggatgaggtcacccaaatattctttggctttgaggatgagcctgatgcccgctttgtgcagctggaagactgcagccacatctttgaggtgcaagccctagaccgctacatgaatgaacagaaggatgatgaagtcgccatcagattgaaagtctgccctatctgccaggtgcccatccgcaaaaacctgaggtatggaactagcataaaacagcggctagaagagattgaaatcatcaaggaaaagatccagggctcagcaggggaaatagcaaccagccaggaacggcttaaggccctgctggagaggaagagcctcctccaccagctgcttcctgaagacttcctgatgttaaaggagaagctggcccagaaaaatctgtcagtgaaggacctgggtctggttgagaattacatcagcttctatgaccacctggccagcctgtgggattccctgaaaaagatgcatgtcttagaagagaaaagagtgaggactcgactagaacaggtccatgagtggctggccaagaagcgcttgagcttcactagccaggaactaagtgacctccgaagtgaaatccagaggctcacatacctggtgaaccttctgacccgctacaagatagcagagaagaaggtgaaagatagcatagcagtagaggtctatagtgtccagaatatccttgagaaaacatgtaagttcacccaagaggatgaacaacttgtgcaggaaaagatggaagctctgaaagccacccttccctgctctggcctgggcatctcagaggaagagcgagtgcagattgtcagtgccataggttatcctcgtggtcactggttcaagtgccgcaatggccatatctatgtgattggcgattgtgggggagccatggagaggggcacgtgtcctgactgtaaggaagtgattggtggcacaaatcatactctggaaagaagcaaccagcttgcttctgaaatggatggagcccagcatgctgcctggtctgacacggccaacaacctgatgaactttgaggagatccaggggatgatgtaggaagatggtacaccactgccttttgccctcgccactgaatgactggggccagctccctaatgaaggaactgaagtttgttttttattatcatcctttttaggctgggcgcagtggcttacgcctgtaatcccagcactttgggaggccgaggcaggcggatcacgaggtcaggagttcgagaccagcctgaccaacatggcgaaaccccgtctctactaaaaatacaaaaattagctgggcgttatggcgggcgcctgtaatcccagctacttgggaggctgaggcagaagaatcgcttaaacccaggaggcggaggttgcagtgagctgagatcatgccattgcactccagtctgggcgacaggagcaagactctgtctcaaaaaaaaaaaaatcattctttttagtcttagcacctacttaaggatccacttttagggctcacccacatttgtttctagatttacccctgcgctagagtaagcactttatctccagaactgagagcaaagttaacaaatctcaccccttctctcctgcaaattagtggacagactccctggaacatgtttggggcttccacctagggccacctagtggtatctctgggtctttacttggtcagatgtttattctacattgttccccaggaacagagtatgagctcattgatgcagaccgattctaattgccaggccctaatttgcagactaactctcataataaacagaggcccatagttgtttatgaactgcttatcccttaaaggagcacaagaacccctccctgccctccttgggcaccctgcctccaggagatggaggcacgtgataagacaaaagactgcaccaactcaccctgacacagttacatagtcactgagagtggggaagatgggacagcccacatgctgcataagatgggccttatgcagcaggcccaggtcgtcattaaggagtgacccctttcctgtaacctgcactttgggatggtagaagtttctttacctgctgacaggtttggtggcactgctggttacccctgggccctgaatggagctaaaatcacatttggtaccagcagcacctatcccaagtgtgatccttcatcccaacactccctcttggagctgttccctgggtagagctagcatgccagcagcttctgcaggctccaaacccaggccagaagccagacccaggcctgctgcctgcatctgcattccctccttccagtgttccttagaacagacatttaggtatctcaggtcctttctaagtgtccctttcctatgtatgcatttcctttttttgtctttactatgcactttagcttataaagccaattaaaaacaatgattgagaaaa

SEQ ID NO: 204691 - DNA, 2122 bp, Homo sapiens
  Payload ID: 20373
  Gene Name: zinc finger, NFX1-type containing 1
  ENST ID: ENST00000455070
  CDS Start-End: 1-2122
tccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatacgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagacagtaccctgcctggtattgatgtctgcagacccagcgcaaccag

SEQ ID NO: 204692 - DNA, 5695 bp, Homo sapiens
  Payload ID: 20374
  Gene Name: zinc finger, RAN-binding domain containing 1
  Uniprot ID: Q9UGI0
  ENST ID: ENST00000359653
  CDS Start-End: 372-2498
gtgatggcctccctgaaattaaacatttctattagtggcttcccgttaatctcatccttcttagatcaaacctcgttatatctcctgcctatctcttttgcattccaaagttcagttttattaaatcccagggtctaagattttttctttgagaatttatctccagtgtttctatggaaattaaaaaagaaaattaggataattcaatgtcgaaatgttgcatgcatcttttgagaaatttatattttgtaggttgaaggacttgctttttgggcagcgtatttttggaggtggaatgtagttattttaataaccatgtcctaattatttatagcttcctgcctgacacagctcacttcaagaagtgcacaatgtcagaacgtggaattaagtgggcttgtgaatattgtacgtatgaaaactggccatctgcaatcaagtgtactatgtgtcgtgcccaaagacctagtggaacaattattacagaagatccatttaaaagtggttcaagtgatgttggtagagattgggatccttccagcaccgaaggaggaagtagtcctttgatatgtccagactctagtgcaagaccaagggtgaaatcttcgtatagcatggaaaatgcaaataagtggtcatgccacatgtgtacatatttgaactggccaagagcaatcagatgtacccagtgcttatcccaacgtaggaccaggagtcctacagaatctcctcagtcctcaggatctggctcaagaccagttgctttttctgttgatccttgtgaggaatacaatgatagaaataaactgaacactaggacacagcactggacttgctctgtttgcacatatgaaaactgggccaaggctaaaagatgtgttgtttgtgatcatcccagacctaataacattgaagcaatagaattggcagagactgaagaggcttcttcaataataaatgagcaagacagagctcgatggaggggaagttgcagtagtggtaatagccaaaggagatcacctcctgctacgaagcgggactctgaagtgaaaatggattttcagaggattgaattggctggtgctgtgggaagcaaggaggaacttgaagtagactttaaaaaactaaagcaaattaaaaacaggatgaaaaagactgattggctcttcctcaatgcttgtgtgggggttgtagaaggtgatttagctgccatagaagcatacaagtcatcaggaggagacattgcacgtcagctcaccgcagatgaagtacgcttgctgaatcgtccttctgcctttgatgttggctatactcttgtacacttggctatacgttttcagaggcaggatatgctagcaatattgcttacagaggtgtctcaacaagcagcaaagtgtattccagcaatggtgtgtcctgaactgacagaacaaatccggagagagatagctgcctctcttcatcagagaaagggggattttgcttgctattttctgactgaccttgtaacatttacattgccagcagatattgaagatttgcccccaacagtccaagaaaaattatttgatgaggtgcttgatagagacgttcaaaaagaattagaagaagaatctccaattattaactggtccttggaattggctacacgtttggacagtcgactgtatgcactttggaaccggactgcaggagactgcctacttgattcagttctacaagctacctggggcatctatgacaaggactcagtgcttcggaaagccctgcatgacagcctgcatgactgttcacattggttttacacacgctggaaagattgggaatcatggtattctcagagctttggtttacatttttccttgagagaagaacagtggcaagaagactgggcatttatactctctcttgctagtcagcctggagcaagcttggagcagacgcacatttttgtactggcacatattcttagacgaccaattatagtttatggagtaaaatattacaagagtttccggggagaaactttaggatatactcggtttcaaggtgtttatctgcctttgttgtgggaacagagtttttgttggaaaagtccgattgctctgggttatacgaggggccacttctctgctttggttgccatggaaaatgatggctatggcaaccgaggtgctggtgctaatctcaataccgatgatgatgtcaccatcacatttttgcctctggttgacagtgaaaggaagctactccatgtgcacttcctttctgctcaggagctaggtaatgaggaacagcaagaaaaactgctcagggagtggctggactgctgtgtgacggaggggggagttctggttgccatgcagaagagttctcggcggcgaaatcaccccctggtcactcagatggtagaaaaatggcttgaccgctaccgacagatccggccgtgtacatccctgtctgatggagaggaagatgaggatgatgaagatgaatgaaaaaaaaaatcaaacagcagaagaccaaggcatcagatctgtaatgaccctaaagttagtgtggtgctccaagcagagtcgacatcatggaatgaaccaaatctggcaggatctgctcggggaagtgttttcctggaccacacacaccttatggagataatgcctctgctgcgtgaggagacagagaactttagttggactacagtttgtaaaaaaaactaattttattaagacagaactttttttccttccaaattgtaaatctgtctataaatgtaacgcatgtggttgtgtaagacattgtttaataggaaaagttgtaccagcatcttcatattattgagaaaattttttccagcatgggcacttagaaaaagcacatggcaaatggctctttgttcctttcagatattatttcagtagaacctggcattctactttcaccttaaaagatccatctaagtctcagatctggaaacgttttgtaccgattatccacagcaaaacaaaaataagcttttattttattaataatttcgttcctcttgtgcccaatcaaatcttttaggaacaaactgcaagaaaagctaagaatgttttagagtgaactaaatacagacattgcttacttgttttgaagagggttttggttttggttattgtgtctttaagttttctgatatgccccctttcaatatttagatatttatttgttgggaagaataccttaaaatgagggttcttattccagattctgggcagtggtctgtgagtagtttttttcctggatgaaaagggagcaagcccacttgtcactaaatgaattgtgtgaaatgtgctcacttggactccatcaacaatgtgctgctcccagattgccatgccagagggtcttcggattcttccttctatcacctctgctctaagcaaatcttgttagaagggcatgcctttgcttaggcagattgggaataccaattcactacagaataaagattttaaaaatgcaataaggtggcaaatgcattgtatgaagaatttctcagtgtttagtctgagaatttttgcatgttggttaattgtggccattctttaatttaaagttaaaactataatcttaggtagaaaaacttttttataagaagtattatttgaccacttcaggtatacattcaatactgggtaaaaatttcagacctatctcaggaacacagaaatatttggtgtcctgataagcactttctagactattgatgtggccaggaatttggaaagacgacacacgcacgcgcgcgcgcgcacacacacacacacacacacacacacacacagttttttccttccctgtgatgaaaaaggctgtgaaaaccttaaagtatttgcttgcttcttgttttgtttagttgataatgaaatgtgtacaacctcaaatttgctgccagaatactaaaaatagaaaaatacccacaaaactgtcatgtctttagttctttccccccgaaaactcagtaaaaaggtgttcccaggatgaaaagatcattttttgctgcatgctaaatcttgcaggaaaaatgattttttagtacgattctgtagaaatgaatctttgatataatgtaaatgctgctgtttgtttcaagtggtgaatgtgttgttaaaaattggctgtttgctttcattttggccaataagtaatcaagtttgtagaaaatgttagcattctgactacttagcatctgtagtaatttctctatgtatagggataattttttagtgggcagagatcctgttctagttgcctgttaagcaaaatctgccctcccaattgaaaaagccaaagagaattgttagagggaaaagcatgtagccattgcagtctgcattgcagccagcgttgtccagagtacacgctcagcacttagcttctactgtgtgttgtggtctggtgagtgttgtttcccctgagcgctctattatttatttatttattatcaatcagtgaccctgaccacatagtgtgataggtgcagcattcttccctgtgggaaagaattaaagatggttccatttcctaggctacagacaggaatggggctctaaatggttttcatagactggctgttaaaggccaaaaattttggtaaatcaatgctatattatgctcttgaactattaaaacagccataattattgtcccaagatagaatatagtcctttttcaaagatgattatacgtggctaggtgacagacattaatgactgactctggagagtaagtcatacctgcactctgtggacttgatggttctttttctagagcaaacagagcgtggcattttgttttgacttgttcttccttggggtcaaatttatatatatatatataaatttttgtttgggcgaccaagatctaataattaaaacccaggtggaccatggattcagacctgcctttttatgtttttgactcttaggttcatcgtgtcccagacttcttcacatattcgtgaaggtaagatattctgtgtgcgcttggcctccttttcacgcatatttcattgcctctttgatgagtggttacgaagacgttaaactacctttttgttccctggggtaataggtcagtaactatgagcgccgtctctctccatgtgagcttgtgttaatagacacttttatggtagagttgggatggggccaccaccttaaaatgagtgagcagacaaggccaggcaagccaaaggctttaagacaccatgattttcttgttttgttttaattgggaagggaagtataaggaagagctcagagggagtttcatacctggaattgttggacttaattgacacttgcaaatacttttagtataaaggtttaattctatttaaaaagaagatccattaaatcaagctcttaactcatgggactatttgcaacacttctttgtaaatatcattttgtttgttaggttattggcaaaacagtttcaaggttcacttccctcccttgaaccaggtccaggtcattttgctttggggtagattaaagtcagaactctaaaagttgagcaactttgtttttttttgaattgatttagcactaacccaccattgcatcttaaggatggcatgacgtgataatgatggacttgtgtgaggttttgatttttcaattaaactttttgttatcacaggtaa

SEQ ID NO: 204693 - DNA, 2821 bp, Homo sapiens
  Payload ID: 20375
  Gene Name: zinc finger, RAN-binding domain containing 2
  Uniprot ID: O95218
  ENST ID: ENST00000254821
  CDS Start-End: 17-979
gctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagccaggtgattggtgaaaacactaaacaaccctgagcccagggccaacccctacggaacaccactactttacccagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagca

SEQ ID NO: 204694 - DNA, 3078 bp, Homo sapiens
  Payload ID: 20375
  Gene Name: zinc finger, RAN-binding domain containing 2
  Uniprot ID: O95218
  ENST ID: ENST00000370920
  CDS Start-End: 303-1295
ccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 204695 - DNA, 2808 bp, Homo sapiens
  Payload ID: 20375
  Gene Name: zinc finger, RAN-binding domain containing 2
  ENST ID: ENST00000610633
  CDS Start-End: 35-1048
atagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaagatccagctccaggtccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctg

SEQ ID NO: 204696 - DNA, 1257 bp, Homo sapiens
  Payload ID: 20375
  Gene Name: zinc finger, RAN-binding domain containing 2
  Uniprot ID: O95218
  ENST ID: ENST00000611683
  CDS Start-End: 295-1257
tctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagccaggtgattggtgaaaacactaaacaaccctga

SEQ ID NO: 204697 - DNA, 4046 bp, Homo sapiens
  Payload ID: 20376
  Gene Name: zinc finger, RAN-binding domain containing 3
  Uniprot ID: Q5FWF4
  ENST ID: ENST00000264159
  CDS Start-End: 118-3357
ccaatggtaaaactaggaggacagccattttgcccacttgtaaaagagctaccttttcccacgagttggagcctgaggtgcggagtttcgtgagtttttactgactcgaggatcatcatgcctagggttcataacataaaaaagtctcttacacctcacatttcttgtgtgacaaatgaatctgataatctgctggattttttgcctgacagactaagagcaaagctacttccattccagaaagatggcatcatttttgccctcaaaagaaatggcaggtgtatggtggctgatgaaatgggtctaggaaagacaatccaggcaattggaattacttacttctataaagaggaatggcctctgttaatagtggtcccttcgtctctgaggtacccttggacagaagaaattgaaaaatggatcccagagctaagtccagaagaaatcaatgttattcagaataaaactgatgttaggagaatgtcgaccagtaaagtgacagttctgggttatggtctcttaaccgcagatgcaaagactttgatagatgcactgaataatcagaacttcaaagtagttatagtggatgaatcacactacatgaaatccagaaatgcaactcgcagcaggattttattgccaatagtacagaaagccagacgagccattcttcttacaggaacaccagctttaggaaggcctgaagagctttttatgcagattgaagctctctttccacaaaaatttggaagatggaccgactatgcaaaaagatactgtaatgcacacatcagatattttggtaaaagacctcagtgggattgtagaggggcatcaaatcttaatgaacttcaccagctattaagtgacataatgattagaagattaaagactgaagttttaacccagctaccccctaaagtcagacagcgtattccatttgatcttccatcagcagctgccaaggaattgaataccagctttgaagagtgggaaaaaataatgagaactccaaattcaggtgccatggagacagtcatggggttgataactcgcatgtttaaacaaactgctattgccaaggcaggtgctgtaaaggattatattaagatgatgcttcagaatgattcgcttaaatttctggtttttgctcaccatttaagcatgctccaagcttgcacagaagcagtcatcgaaaataagactcgttacattaggatagatggaagtgtttcatcttcagaaagaatacatctggttaatcagtttcaaaaggatcctgacactcgcgtggctatcctaagcattcaggctgctggccagggattaacatttactgcagcaagtcatgttgtatttgctgagttgtactgggaccctggacatataaaacaagcagaagaccgagctcacagaattggccagtgcagttctgtgaatattcactaccttattgcaaatggaaccctagacacccttatgtggggaatgttgaatcgcaaggctcaagttacagggagcacactgaacggtaggaaagaaaaaattcaggctgaggaaggtgataaggaaaaatgggatttcctgcagtttgctgaagcttggactccaaatgacagttctgaagagttaaggaaggaagctttgttcactcacttcgaaaaagaaaaacagcatgatattcgatcattttttgtaccacaacctaaaaaaagacagttgatgacctcctgtgacgaatcaaagagattccgggaggaaaatactgtagtgtcatcagaccctacaaaaacagctgcaagagatatcatcgattatgaaagtgatgttgaacctgaaacgaaaagattgaaattggctgcctcggaagaccactgcagtccgtcggaagagacaccatcccagtccaagcaaatccgaactccactcgtggaaagtgtacaggaggccaaggcccagttaaccaccccagcctttcctgtagagggctggcaatgtagtctctgcacctatatcaataattcagagttaccttattgtgaaatgtgtgagactcctcaaggcagtgctgttatgcaaatagatagcctcaaccatatccaggataaaaacgagaaggatgattctcagaaagacacctccaaaaaggttcaaactatctcagactgtgaaaaacaagcccttgcacagtcagaacctggccagttggctgacagcaaggaagaaacaccaaaaattgagaaagaagacggacttacatcccagccaggtaatgaacagtggaagagttcagacactttgccagtgtatgacaccttaatgttctgtgcaagtaggaatactgaccggattcacatctatactaaggatggaaaacagatgagctgtaatttcattcctctggatataaaattagacctttgggaagatttaccagcaagctttcagctgaaacaatatcgctcactgattttgagatttgttcgagaatggagtagtctaactgccatgaagcaaaggataatcaggaaaagtggacagctattctgtagcccaattcttgctttggaagagatcacaaagcaacaaaccaaacaaaattgcaccaaaagatacataaccaaagaagatgttgccgtagcctcaatggacaaagtgaagaatgttgggggccatgtccgtctgatcacaaaggagtccaggccacgggatcctttcacaaaaaaacttcttgaagatggagcctgtgtcccatttctaaatccatacacagtccaggcagatctcactgtgaagccctctacatccaaaggctatttgcaagctgtggataatgaaggaaatccactttgccttcgctgtcagcaacccacttgccagactaagcaagcatgtaaagcgaactcttgggattcacggttttgctctctgaaatgtcaggaagagttttggattcgatctaataacagttacctgagagccaaagtatttgaaactgaacatggtgtgtgtcagctctgtaatgtgaacgcacaagaactctttttacgtctgagagatgcccctaaaagtcagaggaagaatcttctgtatgctacctggacttcaaagctcccattagaacagctaaatgaaatgataagaaacccaggggaaggacatttctggcaggtggatcacatcaagccagtgtatgggggaggaggacagtgttccctggacaacctgcagactctctgcacagtctgtcacaaagagagaactgccagacaagctaaggaaagaagccaggtgagaagacaatctctagcatcaaagcatggatcagacatcacacgatttttggtaaagaagtaaagtagaaaaatatatgaatgaatgacaaatggtttacatgtggaagactttaatacagaagttttccatgtttgtttaatatatcgagagtaaaaattttcagaacaaaaatcaagaattcaaattctcttctactaattacttttagtattaaatacattttgaaagtacttaacagaaactaagatacaatactgaatatttctgtggtctttttgatttgattcagactcgcaattatgtttcagcaatgttttgtaaagctctttacccctaatatgcctaatcactgtattgtgcatagattgtgtttaaaaaatgtactctcaattacctaaaaatgcttctggattagtattgttctggactgtcataggtatgagtggaacattgcaaaaccttatgggaaatttcagacgcaaatcattatttgggaattctgggccaagcatgaccagcctgcttaggattcaagagagactgtccactaaatacctccagaatgagctaggggcacacattttgggtgttgcttttcttgctttatttcttagctagtcatctttatcaaaaatatccttttcaaaatgaggtacctatggtgtttgtggacaatttgggggttctgtgtaaagtaattgttaaaactattaaataactgaaaacataaaatgtaaaatgccacttaa

SEQ ID NO: 204698 - DNA, 6820 bp, Homo sapiens
  Payload ID: 20376
  Gene Name: zinc finger, RAN-binding domain containing 3
  Uniprot ID: Q5FWF4
  ENST ID: ENST00000401392
  CDS Start-End: 214-3447
cccttttcgcaaccctaacgggagagaagtgatggaagaagggtagccggaagagtttcctcaaaataccataggggttttaaattattagtacgtatttaaactcatctactttcacgttgtcccgttgaacgtcacttccgcttaggggcggacacgtcccaaacctgtggcgggagttggagattctgcggcgaatacgccaggatcatcatgcctagggttcataacataaaaaagtctcttacacctcacatttcttgtgtgacaaatgaatctgataatctgctggattttttgcctgacagactaagagcaaagctacttccattccagaaagatggcatcatttttgccctcaaaagaaatggcaggtgtatggtggctgatgaaatgggtctaggaaagacaatccaggcaattggaattacttacttctataaagaggaatggcctctgttaatagtggtcccttcgtctctgaggtacccttggacagaagaaattgaaaaatggatcccagagctaagtccagaagaaatcaatgttattcagaataaaactgatgttaggagaatgtcgaccagtaaagtgacagttctgggttatggtctcttaaccgcagatgcaaagactttgatagatgcactgaataatcagaacttcaaagtagttatagtggatgaatcacactacatgaaatccagaaatgcaactcgcagcaggattttattgccaatagtacagaaagccagacgagccattcttcttacaggaacaccagctttaggaaggcctgaagagctttttatgcagattgaagctctctttccacaaaaatttggaagatggaccgactatgcaaaaagatactgtaatgcacacatcagatattttggtaaaagacctcagtgggattgtagaggggcatcaaatcttaatgaacttcaccagctattaagtgacataatgattagaagattaaagactgaagttttaacccagctaccccctaaagtcagacagcgtattccatttgatcttccatcagcagctgccaaggaattgaataccagctttgaagagtgggaaaaaataatgagaactccaaattcaggtgccatggagacagtcatggggttgataactcgcatgtttaaacaaactgctattgccaaggcaggtgctgtaaaggattatattaagatgatgcttcagaatgattcgcttaaatttctggtttttgctcaccatttaagcatgctccaagcttgcacagaagcagtcatcgaaaataagactcgttacattaggatagatggaagtgtttcatcttcagaaagaatacatctggttaatcagtttcaaaaggatcctgacactcgcgtggctatcctaagcattcaggctgctggccagggattaacatttactgcagcaagtcatgttgtatttgctgagttgtactgggaccctggacatataaaacaagcagaagaccgagctcacagaattggccagtgcagttctgtgaatattcactaccttattgcaaatggaaccctagacacccttatgtggggaatgttgaatcgcaaggctcaagttacagggagcacactgaacggtaggaaagaaaaaattcaggctgaggaaggtgataaggaaaaatgggatttcctgcagtttgctgaagcttggactccaaatgacagttctgaagagttaaggaaggaagctttgttcactcacttcgaaaaagaaaaacagcatgatattcgatcattttttgtaccacaacctaaaaaaagacagttgatgacctcctgtgacgaatcaaagagattccgggaggaaaatactgtagtgtcatcagaccctacaaaaacagctgcaagagatatcatcgattatgaaagtgatgttgaacctgaaacgaaaagattgaaattggctgcctcggaagaccactgcagtccgtcggaagagacaccatcccagtccaagcaaatccgaactccactcgtggaaagtgtacaggaggccaaggcccagttaaccaccccagcctttcctgtagagggctggcaatgtagtctctgcacctatatcaataattcagagttaccttattgtgaaatgtgtgagactcctcaaggcagtgctgttatgcaaatagatagcctcaaccatatccaggataaaaacgagaaggatgattctcagaaagacacctccaaaaaggttcaaactatctcagactgtgaaaaacaagcccttgcacagtcagaacctggccagttggctgacagcaaggaagaaacaccaaaaattgagaaagaagacggacttacatcccagccagaacagtggaagagttcagacactttgccagtgtatgacaccttaatgttctgtgcaagtaggaatactgaccggattcacatctatactaaggatggaaaacagatgagctgtaatttcattcctctggatataaaattagacctttgggaagatttaccagcaagctttcagctgaaacaatatcgctcactgattttgagatttgttcgagaatggagtagtctaactgccatgaagcaaaggataatcaggaaaagtggacagctattctgtagcccaattcttgctttggaagagatcacaaagcaacaaaccaaacaaaattgcaccaaaagatacataaccaaagaagatgttgccgtagcctcaatggacaaagtgaagaatgttgggggccatgtccgtctgatcacaaaggagtccaggccacgggatcctttcacaaaaaaacttcttgaagatggagcctgtgtcccatttctaaatccatacacagtccaggcagatctcactgtgaagccctctacatccaaaggctatttgcaagctgtggataatgaaggaaatccactttgccttcgctgtcagcaacccacttgccagactaagcaagcatgtaaagcgaactcttgggattcacggttttgctctctgaaatgtcaggaagagttttggattcgatctaataacagttacctgagagccaaagtatttgaaactgaacatggtgtgtgtcagctctgtaatgtgaacgcacaagaactctttttacgtctgagagatgcccctaaaagtcagaggaagaatcttctgtatgctacctggacttcaaagctcccattagaacagctaaatgaaatgataagaaacccaggggaaggacatttctggcaggtggatcacatcaagccagtgtatgggggaggaggacagtgttccctggacaacctgcagactctctgcacagtctgtcacaaagagagaactgccagacaagctaaggaaagaagccaggtgagaagacaatctctagcatcaaagcatggatcagacatcacacgatttttggtaaagaagtaaagtagaaaaatatatgaatgaatgacaaatggtttacatgtggaagactttaatacagaagttttccatgtttgtttaatatatcgagagtaaaaattttcagaacaaaaatcaagaattcaaattctcttctactaattacttttagtattaaatacattttgaaagtacttaacagaaactaagatacaatactgaatatttctgtggtctttttgatttgattcagactcgcaattatgtttcagcaatgttttgtaaagctctttacccctaatatgcctaatcactgtattgtgcatagattgtgtttaaaaaatgtactctcaattacctaaaaatgcttctggattagtattgttctggactgtcataggtatgagtggaacattgcaaaaccttatgggaaatttcagacgcaaatcattatttgggaattctgggccaagcatgaccagcctgcttaggattcaagagagactgtccactaaatacctccagaatgagctaggggcacacattttgggtgttgcttttcttgctttatttcttagctagtcatctttatcaaaaatatccttttcaaaatgaggtacctatggtgtttgtggacaatttgggggttctgtgtaaagtaattgttaaaactattaaataactgaaaacataaaatgtaaaatgccacttaagcttgattttttagatctttttttaaaaaatgaataaaactaggcttactgttggctgggcgcggtggctcacgcatgtaatcccagcactttgggaggccaaagcgggtggatcatgaggtcaggagatagatcgagaccatcctggctaatacggtgaaaccccatctctactaaaaatacaaaaaattagccgggcatggtgttgtgcacgtgtaatctcagatactcgggaggctgaggcaggagaattgcttgaacccgggaagcagaggttgcagtgagccgagatcacgccattgaactccagcctgggcgacagagcgagactccgtctcaaacaaacaaacaaacaaaaaaaaaaactaagcgtactatcaaaatacactttgtcttctggttctcattttctgtttttaaaaccctgtgttattaaaggtatgtttctggtacttattttaaaaagagtgatgatgacaaaacactttataataaggcataatcagatggttatatgcatttaaatatacaataataacattaaaatgtaattgacataaaataagagtgacgatgaaacaaacccagggcctagtcctgcaatatgtcagaatcatgagggcaaagagtcagaactatacaaaatacaggaccgaggaagaattacattcccaaaagggagctgtttgtaaatactattaggacatatacctctttagtttgagcattttcccacgttaattaatagctagtgttttacaacataaaggacttgtttttagaaagattatacaatcaaagattatacaaccacagttgttcctcagtttctatttcattgtatgagatcaagtcatgttggttattttataaatgaagttgggctttctttggcctcctttctgcttagttggtcaggtgctctttgcagttttctgcctcatttccaaggtaacctaggatttgtcacggttgagagccaagaagcaggcacgctgcctttcctccagcatggggttttgcaagcgaggtctaagtaggtcaaatttgaggggaacttgctcttcagatcacactaaggtgataattctaaggagaaagttctcagatgtaagaactgtgtgatggtttgaggtgaaacaatccatgaagataggctcagtctataccaggtttcagaattctgactaattaaaaatgccgtaaggagcattgagcatttgctgtacaggacactgactggcccgtccccatcccttcctgacatgtctcagagctttgtgtcctgccttcccctaatttggtctgcattacttgtggggcacattgagatgaagggttctgagacagaaaataaagatagagattgatctaataaccgagaccgaaagggcatcttgaggactgttctttcctcctcacaatctgaaacagaagctccccactatgtattgcaaatgggaggttatgacagagggacacagaaagtgtcagagcaagtggcagatcctgagtgcagaaggaagtgcagatgccccaggaagaagacagctgctgccactcaggagatggagatggagtgaaaacacaggtgggtacaatgagtgtaaaaggataggcctggctctgaaaagactcagagaagctgcaagatacagtttaggctaagaaaacaacaacaaaaaagggctctggccaggtatgatggcacttgcttgtagtcctagctacacaggaggctgaggtaggagggtcacttaagcccaggggttcatgaccagcctgggtaacacagcaaggccccatctcaaaaaagaaaaaaggctctgggtccagggaacagagctgggaagtggtaggtgacgaaggaactcgcttacgatagggaaccatatgaaaatatgcctgtgggtaggggtagggtggggaggacttccggagcatggtgggctcacacactcaaaccttgcacagccagcatcaggctggcctgccttcctgttcccgtcactgggtgacattgatcccagacacattctgatgactagtaaagttgcttttagtagccccagagccaggaggaataattcatatggaatttttaaagacgcccactcttggcgttaattacagcccaacgtacatttcttggggagattttcctgtgacaagtgaataccctctacattttcttaactggatgggaaaaggattttatgcccatacatcttgctaataaaccaaatcccttcttcagattcttgagtgaaacatttaaaatgtagtttctttagaaataaaagtatgaggcattttaaattatatgacagacaaaaaagtcaatgctcttgagctctttacagtaaataggttgtgtttactcataggatacagaatcatggatatcaaacatcaaaaataaattataaaaataatgtctcattttctgttgcatattattagcctgtctctcattccaccatttgttcttttgaactggaaaattgtgggctcctagtcactgcactaatctatctgaatatccaactaccagaaagggtttatcccatctcaagtttgtcagttgctttatatcgttaagggtgtttttgccaccctggttgtgttcataattaccattgagaaatgtcactgttattaaaatacattctgtgttccaacta

SEQ ID NO: 204699 - DNA, 4130 bp, Homo sapiens
  Payload ID: 20376
  Gene Name: zinc finger, RAN-binding domain containing 3
  ENST ID: ENST00000403017
  CDS Start-End: 123-1409
ttgtcccgttgaacgtcacttccgcttaggggcggacacgtcccaaacctgtggcgggagttggagattctgcggcgaatacgccaggtgtgactggctggaagtggcgtggctggatcatcatgcctagggttcataacataaaaaagtctcttacacctcacatttcttgtgtgacaaatgaatctgataatctgctggattttttgcctgacagactaagagcaaagctacttccattccagaaagatggcatcatttttgccctcaaaagaaatggcaggtgtatggtggctgatgaaatgggtctaggaaagacaatccaggcaattggaattacttacttctataaagaggaatggcctctgttaatagtggtcccttcgtctctgaggtacccttggacagaagaaattgaaaaatggatcccagagctaagtccagaagaaatcaatgttattcagaataaaactgatgttaggagaatgtcgaccagtaaagtgacagttctgggttatggtctcttaaccgcagatgcaaagactttgatagatgcactgaataatcagaacttcaaagtagttatagtggatgaatcacactacatgaaatccagaaatgcaactcgcagcaggattttattgccaatagtacagaaagccagacgagccattcttcttacaggaacaccagctttaggaaggcctgaagagctttttatgcagattgaagctctctttccacaaaaatttggaagatggaccgactatgcaaaaagatactgtaatgcacacatcagatattttggtaaaagacctcagtgggattgtagaggggcatcaaatcttaatgaacttcaccagctattaagtgacataatgattagaagattaaagactgaagttttaacccagctaccccctaaagtcagacagcgtattccatttgatcttccatcagcagctgccaaggaattgaataccagctttgaagagtgggaaaaaataatgagaactccaaattcaggtgccatggagacagtcatggggttgataactcgcatgtttaaacaaactgctattgccaaggcaggtgctgtaaaggattatattaagatgatgcttcagaatgattcgcttaaatttctggtttttgctcaccatttaagcatgctccaagcttgcacagaagcagtcatcgaaaataagactcgttacattaggatagatggaagtgtttcatcttcagaaagaatacatctggttaatcagtttcaaaaggatcctgacactcgcgtggctatcctaagcattcaggctgctggccaggacctgtatgacaaggtggcctgggggaaaagaactcttgtctcaggactttttatggagtgcttctgttttgtcccttaggattaagtttgaagggattaacatttactgcagcaagtcatgttgtatttgctgagttgtactgggaccctggacatataaaacaagcagaagaccgagctcacagaattggccagtgcagttctgtgaatattcactaccttattgcaaatggaaccctagacacccttatgtggggaatgttgaatcgcaaggctcaagttacagggagcacactgaacggtaggaaagaaaaaattcaggctgaggaaggtgataaggaaaaatgggatttcctgcagtttgctgaagcttggactccaaatgacagttctgaagagttaaggaaggaagctttgttcactcacttcgaaaaagaaaaacagcatgatattcgatcattttttgtaccacaacctaaaaaaagacagttgatgacctcctgtgacgaatcaaagagattccgggaggaaaatactgtagtgtcatcagaccctacaaaaacagctgcaagagatatcatcgattatgaaagtgatgttgaacctgaaacgaaaagattgaaattggctgcctcggaagaccactgcagtccgtcggaagagacaccatcccagtccaagcaaatccgaactccactcgtggaaagtgtacaggaggccaaggcccagttaaccaccccagcctttcctgtagagggctggcaatgtagtctctgcacctatatcaataattcagagttaccttattgtgaaatgtgtgagactcctcaaggcagtgctgttatgcaaatagatagcctcaaccatatccaggataaaaacgagaaggatgattctcagaaagacacctccaaaaaggttcaaactatctcagactgtgaaaaacaagcccttgcacagtcagaacctggccagttggctgacagcaaggaagaaacaccaaaaattgagaaagaagacggacttacatcccagccagaacagtggaagagttcagacactttgccagtgtatgacaccttaatgttctgtgcaagtaggaatactgaccggattcacatctatactaaggatggaaaacagatgagctgtaatttcattcctctggatataaaattagacctttgggaagatttaccagcaagctttcagctgaaacaatatcgctcactgattttgagatttgttcgagaatggagtagtctaactgccatgaagcaaaggataatcaggaaaagtggacagctattctgtagcccaattcttgctttggaagagatcacaaagcaacaaaccaaacaaaattgcaccaaaagatacataaccaaagaagatgttgccgtagcctcaatggacaaagtgaagaatgttgggggccatgtccgtctgatcacaaaggagtccaggccacgggatcctttcacaaaaaaacttcttgaagatggagcctgtgtcccatttctaaatccatacacagtccaggcagatctcactgtgaagccctctacatccaaaggctatttgcaagctgtggataatgaaggaaatccactttgccttcgctgtcagcaacccacttgccagactaagcaagcatgtaaagcgaactcttgggattcacggttttgctctctgaaatgtcaggaagagttttggattcgatctaataacagttacctgagagccaaagtatttgaaactgaacatggtgtgtgtcagctctgtaatgtgaacgcacaagaactctttttacgtctgagagatgcccctaaaagtcagaggaagaatcttctgtatgctacctggacttcaaagctcccattagaacagctaaatgaaatgataagaaacccaggggaaggacatttctggcaggtggatcacatcaagccagtgtatgggggaggaggacagtgttccctggacaacctgcagactctctgcacagtctgtcacaaagagagaactgccagacaagctaaggaaagaagccaggtgagaagacaatctctagcatcaaagcatggatcagacatcacacgatttttggtaaagaagtaaagtagaaaaatatatgaatgaatgacaaatggtttacatgtggaagactttaatacagaagttttccatgtttgtttaatatatcgagagtaaaaattttcagaacaaaaatcaagaattcaaattctcttctactaattacttttagtattaaatacattttgaaagtacttaacagaaactaagatacaatactgaatatttctgtggtctttttgatttgattcagactcgcaattatgtttcagcaatgttttgtaaagctctttacccctaatatgcctaatcactgtattgtgcatagattgtgtttaaaaaatgtactctcaattacctaaaaatgcttctggattagtattgttctggactgtcataggtatgagtggaacattgcaaaaccttatgggaaatttcagacgcaaatcattatttgggaattctgggccaagcatgaccagcctgcttaggattcaagagagactgtccactaaatacctccagaatgagctaggggcacacattttgggtgttgcttttcttgctttatttcttagctagtcatctttatcaaaaatatccttttcaaaatgaggtacctatggtgtttgtggacaatttgggggttctgtgtaaagtaattgttaaaactattaaataactgaaaacataaaatgtaaaa

SEQ ID NO: 204700 - DNA, 6943 bp, Homo sapiens
  Payload ID: 20376
  Gene Name: zinc finger, RAN-binding domain containing 3
  ENST ID: ENST00000536680
  CDS Start-End: 1698-3575
ccttttcgcaaccctaacgggagagaagtgatggaagaagggtagccggaagagtttcctcaaaataccataggggttttaaattattagtacgtatttaaactcatctactttcacgttgtcccgttgaacgtcacttccgcttaggggcggacacgtcccaaacctgtggcgggagttggagattctgcggcgaatacgccaggtgtgactggctggaagtggcgtggctggatcatcatgcctagggttcataacataaaaaagtctcttacacctcacatttcttgtgtgacaaatgaatctgataatctgctggattttttgcctgacagactaagagcaaagctacttccattccagaaagatggcatcatttttgccctcaaaagaaatggcaggtgtatggtggctgatgaaatgggtctaggaaagacaatccaggcaattggaattacttacttctataaagaggaatggcctctgttaatagtggtcccttcgtctctgaggtacccttggacagaagaaattgaaaaatggatcccagagctaagtccagaagaaatcaatgttattcagaataaaactgatgttaggagaatgtcgaccagtaaagtgacagttctgggttatggtctcttaaccgcagatgcaaagactttgatagatgcactgaataatcagaacttcaaagtagttatagtggatgaatcacactacatgaaatccagaaatgcaactcgcagcaggattttattgccaatagtacagaaagccagacgagccattcttcttacaggaacaccagctttaggaaggcctgaagagctttttatgcagattgaagctctctttccacaaaaatttggaagatggaccgactatgcaaaaagatactgtaatgcacacatcagatattttggtaaaagacctcagtgggattgtagaggggcatcaaatcttaatgaacttcaccagctattaagtgacataatgattagaagattaaagactgaagttttaacccagctaccccctaaagtcagacagcgtattccatttgatcttccatcagcagctgccaaggaattgaataccagctttgaagagtgggaaaaaataatgagaactccaaattcaggtgccatggagacagtcatggggttgataactcgcatgtttaaacaaactgctattgccaaggcaggtgctgtaaaggattatattaagatgatgcttcagaatgattcgcttaaatttctggtttttgctcaccatttaagcatgctccaagcttgcacagaagcagtcatcgaaaataagactcgttacattaggatagatggaagtgtttcatcttcagaaagaatacatctggttaatcagtttcaaaaggatcctgacactcgcgtggctatcctaagcattcaggctgctggccaggacctgtatgacaaggtggcctgggggaaaagaactcttgtctcaggactttttatggagtgcttctgttttgtcccttaggattaagtttgaagggattaacatttactgcagcaagtcatgttgtatttgctgagttgtactgggaccctggacatataaaacaagcagaagaccgagctcacagaattggccagtgcagttctgtgaatattcactaccttattgcaaatggaaccctagacacccttatgtggggaatgttgaatcgcaaggctcaagttacagggagcacactgaacggtaggaaagaaaaaattcaggctgaggaaggtgataaggaaaaatgggatttcctgcagtttgctgaagcttggactccaaatgacagttctgaagagttaaggaaggaagctttgttcactcacttcgaaaaagaaaaacagcatgatattcgatcattttttgtaccacaacctaaaaaaagacagttgatgacctcctgtgacgaatcaaagagattccgggaggaaaatactgtagtgtcatcagaccctacaaaaacagctgcaagagatatcatcgattatgaaagtgatgttgaacctgaaacgaaaagattgaaattggctgcctcggaagaccactgcagtccgtcggaagagacaccatcccagtccaagcaaatccgaactccactcgtggaaagtgtacaggaggccaaggcccagttaaccaccccagcctttcctgtagagggctggcaatgtagtctctgcacctatatcaataattcagagttaccttattgtgaaatgtgtgagactcctcaaggcagtgctgttatgcaaatagatagcctcaaccatatccaggataaaaacgagaaggatgattctcagaaagacacctccaaaaaggttcaaactatctcagactgtgaaaaacaagcccttgcacagtcagaacctggccagttggctgacagcaaggaagaaacaccaaaaattgagaaagaagacggacttacatcccagccaggtaatgaacagtggaagagttcagacactttgccagtgtatgacaccttaatgttctgtgcaagtaggaatactgaccggattcacatctatactaaggatggaaaacagatgagctgtaatttcattcctctggatataaaattagacctttgggaagatttaccagcaagctttcagctgaaacaatatcgctcactgattttgagatttgttcgagaatggagtagtctaactgccatgaagcaaaggataatcaggaaaagtggacagctattctgtagcccaattcttgctttggaagagatcacaaagcaacaaaccaaacaaaattgcaccaaaagatacataaccaaagaagatgttgccgtagcctcaatggacaaagtgaagaatgttgggggccatgtccgtctgatcacaaaggagtccaggccacgggatcctttcacaaaaaaacttcttgaagatggagcctgtgtcccatttctaaatccatacacagtccaggcagatctcactgtgaagccctctacatccaaaggctatttgcaagctgtggataatgaaggaaatccactttgccttcgctgtcagcaacccacttgccagactaagcaagcatgtaaagcgaactcttgggattcacggttttgctctctgaaatgtcaggaagagttttggattcgatctaataacagttacctgagagccaaagtatttgaaactgaacatggtgtgtgtcagctctgtaatgtgaacgcacaagaactctttttacgtctgagagatgcccctaaaagtcagaggaagaatcttctgtatgctacctggacttcaaagctcccattagaacagctaaatgaaatgataagaaacccaggggaaggacatttctggcaggtggatcacatcaagccagtgtatgggggaggaggacagtgttccctggacaacctgcagactctctgcacagtctgtcacaaagagagaactgccagacaagctaaggaaagaagccaggtgagaagacaatctctagcatcaaagcatggatcagacatcacacgatttttggtaaagaagtaaagtagaaaaatatatgaatgaatgacaaatggtttacatgtggaagactttaatacagaagttttccatgtttgtttaatatatcgagagtaaaaattttcagaacaaaaatcaagaattcaaattctcttctactaattacttttagtattaaatacattttgaaagtacttaacagaaactaagatacaatactgaatatttctgtggtctttttgatttgattcagactcgcaattatgtttcagcaatgttttgtaaagctctttacccctaatatgcctaatcactgtattgtgcatagattgtgtttaaaaaatgtactctcaattacctaaaaatgcttctggattagtattgttctggactgtcataggtatgagtggaacattgcaaaaccttatgggaaatttcagacgcaaatcattatttgggaattctgggccaagcatgaccagcctgcttaggattcaagagagactgtccactaaatacctccagaatgagctaggggcacacattttgggtgttgcttttcttgctttatttcttagctagtcatctttatcaaaaatatccttttcaaaatgaggtacctatggtgtttgtggacaatttgggggttctgtgtaaagtaattgttaaaactattaaataactgaaaacataaaatgtaaaatgccacttaagcttgattttttagatctttttttaaaaaatgaataaaactaggcttactgttggctgggcgcggtggctcacgcatgtaatcccagcactttgggaggccaaagcgggtggatcatgaggtcaggagatagatcgagaccatcctggctaatacggtgaaaccccatctctactaaaaatacaaaaaattagccgggcatggtgttgtgcacgtgtaatctcagatactcgggaggctgaggcaggagaattgcttgaacccgggaagcagaggttgcagtgagccgagatcacgccattgaactccagcctgggcgacagagcgagactccgtctcaaacaaacaaacaaacaaaaaaaaaaactaagcgtactatcaaaatacactttgtcttctggttctcattttctgtttttaaaaccctgtgttattaaaggtatgtttctggtacttattttaaaaagagtgatgatgacaaaacactttataataaggcataatcagatggttatatgcatttaaatatacaataataacattaaaatgtaattgacataaaataagagtgacgatgaaacaaacccagggcctagtcctgcaatatgtcagaatcatgagggcaaagagtcagaactatacaaaatacaggaccgaggaagaattacattcccaaaagggagctgtttgtaaatactattaggacatatacctctttagtttgagcattttcccacgttaattaatagctagtgttttacaacataaaggacttgtttttagaaagattatacaatcaaagattatacaaccacagttgttcctcagtttctatttcattgtatgagatcaagtcatgttggttattttataaatgaagttgggctttctttggcctcctttctgcttagttggtcaggtgctctttgcagttttctgcctcatttccaaggtaacctaggatttgtcacggttgagagccaagaagcaggcacgctgcctttcctccagcatggggttttgcaagcgaggtctaagtaggtcaaatttgaggggaacttgctcttcagatcacactaaggtgataattctaaggagaaagttctcagatgtaagaactgtgtgatggtttgaggtgaaacaatccatgaagataggctcagtctataccaggtttcagaattctgactaattaaaaatgccgtaaggagcattgagcatttgctgtacaggacactgactggcccgtccccatcccttcctgacatgtctcagagctttgtgtcctgccttcccctaatttggtctgcattacttgtggggcacattgagatgaagggttctgagacagaaaataaagatagagattgatctaataaccgagaccgaaagggcatcttgaggactgttctttcctcctcacaatctgaaacagaagctccccactatgtattgcaaatgggaggttatgacagagggacacagaaagtgtcagagcaagtggcagatcctgagtgcagaaggaagtgcagatgccccaggaagaagacagctgctgccactcaggagatggagatggagtgaaaacacaggtgggtacaatgagtgtaaaaggataggcctggctctgaaaagactcagagaagctgcaagatacagtttaggctaagaaaacaacaacaaaaaagggctctggccaggtatgatggcacttgcttgtagtcctagctacacaggaggctgaggtaggagggtcacttaagcccaggggttcatgaccagcctgggtaacacagcaaggccccatctcaaaaaagaaaaaaggctctgggtccagggaacagagctgggaagtggtaggtgacgaaggaactcgcttacgatagggaaccatatgaaaatatgcctgtgggtaggggtagggtggggaggacttccggagcatggtgggctcacacactcaaaccttgcacagccagcatcaggctggcctgccttcctgttcccgtcactgggtgacattgatcccagacacattctgatgactagtaaagttgcttttagtagccccagagccaggaggaataattcatatggaatttttaaagacgcccactcttggcgttaattacagcccaacgtacatttcttggggagattttcctgtgacaagtgaataccctctacattttcttaactggatgggaaaaggattttatgcccatacatcttgctaataaaccaaatcccttcttcagattcttgagtgaaacatttaaaatgtagtttctttagaaataaaagtatgaggcattttaaattatatgacagacaaaaaagtcaatgctcttgagctctttacagtaaataggttgtgtttactcataggatacagaatcatggatatcaaacatcaaaaataaattataaaaataatgtctcattttctgttgcatattattagcctgtctctcattccaccatttgttcttttgaactggaaaattgtgggctcctagtcactgcactaatctatctgaatatccaactaccagaaagggtttatcccatctcaagtttgtcagttgctttatatcgttaagggtgtttttgccaccctggttgtgttcataattaccattgagaaatgtcactgttattaaaatacattctgtgttcc

SEQ ID NO: 204701 - DNA, 2494 bp, Homo sapiens
  Payload ID: 20376
  Gene Name: zinc finger, RAN-binding domain containing 3
  Uniprot ID: Q5FWF4
  ENST ID: ENST00000619650
  CDS Start-End: 88-1884
actactgtttgcttttcctagttcgaaaaagaaaaacagcatgatattcgatcattttttgtaccacaacctaaaaaaagacagttgatgacctcctgtgacgaatcaaagagattccgggaggaaaatactgtagtgtcatcagaccctacaaaaacagctgcaagagatatcatcgattatgaaagtgatgttgaacctgaaacgaaaagattgaaattggctgcctcggaagaccactgcagtccgtcggaagagacaccatcccagtccaagcaaatccgaactccactcgtggaaagtgtacaggaggccaaggcccagttaaccaccccagcctttcctgtagagggctggcaatgtagtctctgcacctatatcaataattcagagttaccttattgtgaaatgtgtgagactcctcaaggcagtgctgttatgcaaatagatagcctcaaccatatccaggataaaaacgagaaggatgattctcagaaagacacctccaaaaaggttcaaactatctcagactgtgaaaaacaagcccttgcacagtcagaacctggccagttggctgacagcaaggaagaaacaccaaaaattgagaaagaagacggacttacatcccagccagaacagtggaagagttcagacactttgccagtgtatgacaccttaatgttctgtgcaagtaggaatactgaccggattcacatctatactaaggatggaaaacagatgagctgtaatttcattcctctggatataaaattagacctttgggaagatttaccagcaagctttcagctgaaacaatatcgctcactgattttgagatttgttcgagaatggagtagtctaactgccatgaagcaaaggataatcaggaaaagtggacagctattctgtagcccaattcttgctttggaagagatcacaaagcaacaaaccaaacaaaattgcaccaaaagatacataaccaaagaagatgttgccgtagcctcaatggacaaagtgaagaatgttgggggccatgtccgtctgatcacaaaggagtccaggccacgggatcctttcacaaaaaaacttcttgaagatggagcctgtgtcccatttctaaatccatacacagtccaggcagatctcactgtgaagccctctacatccaaaggctatttgcaagctgtggataatgaaggaaatccactttgccttcgctgtcagcaacccacttgccagactaagcaagcatgtaaagcgaactcttgggattcacggttttgctctctgaaatgtcaggaagagttttggattcgatctaataacagttacctgagagccaaagtatttgaaactgaacatggtgtgtgtcagctctgtaatgtgaacgcacaagaactctttttacgtctgagagatgcccctaaaagtcagaggaagaatcttctgtatgctacctggacttcaaagctcccattagaacagctaaatgaaatgataagaaacccaggggaaggacatttctggcaggtggatcacatcaagccagtgtatgggggaggaggacagtgttccctggacaacctgcagactctctgcacagtctgtcacaaagagagaactgccagacaagctaaggaaagaagccaggtgagaagacaatctctagcatcaaagcatggatcagacatcacacgatttttggaaacctcaaagctgcatgaatcacacaaggtaacaggtgccgagcaaggtctgcaggtttctggattgccagatagtgcagcacctgaaggaggtgcagcgcacacaaatgatcagcgcaggtgtcaaaggatgaagcagccacttacagaagtgcaaatcctcagccactcatcttaatccttaacaagacagcactccagataggcagccacgaccccaaaggcttctggaaccaaactgattaaagttttactcagtggatagttctatagaattaatgatgatgtatgccaaaaacctttcagtgattctaacttcaagcttggaaaaaaagacgaggcttcccagtgtttgtggtggtggatctgcctggttctcaatttgacaccctaagcgatcatactcaagaatagtacagatgtgtggaatacgccaatacctttaactacagacatcatgttctcaagataaaagcctttaaaacaaaaagccatcgtaggtatcaagtcaacatgaaattggaatgcaaaattaatactgctgaggatttccttcatatcccatgctgtttaactatctcttccacagtcctagaatcaatcttttttaattaagagacagggtctgtctttgttacccaggctggagtacagtggtgtcatcaaagctcagtgcagcctccaactcctgggctcaatactcttgcctcagcctcctcttcctgagtagctgcaactacagacacatgccccaatactcagctaatttttaaatttttgtggagatg

SEQ ID NO: 204702 - DNA, 2168 bp, Homo sapiens
  Payload ID: 20377
  Gene Name: zinc finger, SWIM-type containing 1
  Uniprot ID: Q9BR11
  ENST ID: ENST00000372520
  CDS Start-End: 82-1539
ggcgacggagcctggctgtgggcccatctttggaaaaaagatctgggaatgattgtctagcctccagcctcaacttacttgatgcttgagagactcaaagccccgtggtcagctgccctgcaaagaaagtattttgaccttggcatttggacagctcccatctctcccatggccctgacaatgctgaatgggctcctgattaaggactcaagcccacctatgctgctgcaccaggttaacaagactgcccagttagataccttcaactaccagagctgctttatgcaaagtgtctttgaccatttccctgagatcttatttatccaccggacctataacccaaggggtaaggtcttatataccttcctggtggatggacctcgggtgcagctggagggtcatcttgcccgagcagtctactttgccatccctgccaaggaggacactgaaggcctggcccagatgttccaagtattcaagaagtttaatccagcatgggagagagtctgtaccatcctggtggatcctcatttccttccactgcctatcctagctatggagttccccacagctgaggtccttctctcagccttccacatttgtaagttcctccaggccaagttctatcagctgtcccttgaacggcccgtggaaaggctgctcctgacctccctgcagagcacaatgtgctcagccacagcaggcaacctgagaaagttgtatacactcctgagcaactgcatccctccagccaagctgcccgagcttcactcacactggctgctcaacgaccgcatctggctggctcaccgctggagaagccgagctgagagcagccactacttccagagcctcgaggtcaccacccacatcctcagccagttctttggtaccaccccatctgagaaacaaggtatggcttctctgttccgttacatgcagcagaactctgcagacaaggcaaacttcaaccagggcctgtgtgcccagaacaatcatgctccctcagacaccatccccgaaagccccaaactggagcagctggtagaatcccacatccagcactccctcaatgccatctgcacagggccagcagcccaactgtgcctgggcgagcttgctgtggtccagaaatccacacacctcattggctctggctcagaaaagatgaacatacagatcctggaagatacccataaggtgcagccccagccccctgccagctgcagctgctactttaaccaggccttccacctgccctgccgccacatcctagccatgctcagtgcccgccgccaggtgctccagcccgacatgctgccggctcagtggacggcaggctgtgctaccagtctagacagcatcctgggcagcaagtggagtgagaccctggataagcacctggcagtgactcacctcaccgaggaggtgggtcagctgttgcagcactgcaccaaggaggagtttgagcggaggtatagcaccctgcgggaactggccgacagctggattgggccttatgagcaggtccaactctgattattctcgatgcccagagatgctcatgcacctgtgcacactcacatccacccatacacacacacacacacacacacacacacacacacacactcccttacactgttgtacttccgtgggccctccttccagaacaaggacaacaaggacaaggttgaagggtcttctcatctaccatggcctgctacctagcatgtgtctagctcaatgagacaggagtcagcaaatcttaatctgtttagtttactcaggtggccacatacagtctctgttgtatattcttggttttgttttaatattttttttctttttttttttttttttttttttgagaaggagtctgtctccagcctgggagggtgagactccatctaaaaaaaataaaataaatggcaacccctggtctaagataagagataaaacatcaggtggtgaggttgaggtttggggcttggtagcagttgccccagtcatgagatgactcacttaacccgtctcctttaagtgagctgggctgggaggcttcctacaggggaagaggcccctctggggagctgactcagccaggctccctgaacttttttccttgtcccatcctggggtcaataaaactgaatgttgcatattct

SEQ ID NO: 204703 - DNA, 2769 bp, Homo sapiens
  Payload ID: 20377
  Gene Name: zinc finger, SWIM-type containing 1
  Uniprot ID: Q9BR11
  ENST ID: ENST00000372523
  CDS Start-End: 96-1553
aaatagggagaaatggcgacggagcctggctgtgggcccatctttggaaaaaagatctgggaatgattgtctagcctccagcctcaacttacttgatgcttgagagactcaaagccccgtggtcagctgccctgcaaagaaagtattttgaccttggcatttggacagctcccatctctcccatggccctgacaatgctgaatgggctcctgattaaggactcaagcccacctatgctgctgcaccaggttaacaagactgcccagttagataccttcaactaccagagctgctttatgcaaagtgtctttgaccatttccctgagatcttatttatccaccggacctataacccaaggggtaaggtcttatataccttcctggtggatggacctcgggtgcagctggagggtcatcttgcccgagcagtctactttgccatccctgccaaggaggacactgaaggcctggcccagatgttccaagtattcaagaagtttaatccagcatgggagagagtctgtaccatcctggtggatcctcatttccttccactgcctatcctagctatggagttccccacagctgaggtccttctctcagccttccacatttgtaagttcctccaggccaagttctatcagctgtcccttgaacggcccgtggaaaggctgctcctgacctccctgcagagcacaatgtgctcagccacagcaggcaacctgagaaagttgtatacactcctgagcaactgcatccctccagccaagctgcccgagcttcactcacactggctgctcaacgaccgcatctggctggctcaccgctggagaagccgagctgagagcagccactacttccagagcctcgaggtcaccacccacatcctcagccagttctttggtaccaccccatctgagaaacaaggtatggcttctctgttccgttacatgcagcagaactctgcagacaaggcaaacttcaaccagggcctgtgtgcccagaacaatcatgctccctcagacaccatccccgaaagccccaaactggagcagctggtagaatcccacatccagcactccctcaatgccatctgcacagggccagcagcccaactgtgcctgggcgagcttgctgtggtccagaaatccacacacctcattggctctggctcagaaaagatgaacatacagatcctggaagatacccataaggtgcagccccagccccctgccagctgcagctgctactttaaccaggccttccacctgccctgccgccacatcctagccatgctcagtgcccgccgccaggtgctccagcccgacatgctgccggctcagtggacggcaggctgtgctaccagtctagacagcatcctgggcagcaagtggagtgagaccctggataagcacctggcagtgactcacctcaccgaggaggtgggtcagctgttgcagcactgcaccaaggaggagtttgagcggaggtatagcaccctgcgggaactggccgacagctggattgggccttatgagcaggtccaactctgattattctcgatgcccagagatgctcatgcacctgtgcacactcacatccacccatacacacacacacacacacacacacacacacacacacactcccttacactgttgtacttccgtgggccctccttccagaacaaggacaacaaggacaaggttgaagggtcttctcatctaccatggcctgctacctagcatgtgtctagctcaatgagacaggagtcagcaaatcttaatctgtttagtttactcaggtggccacatacagtctctgttgtatattcttggttttgttttaatattttttttctttttttttttttttttttttttgagaaggagtctgtctccgtcacccaggctggagtgcagtggcgcaatctctgctcactgcaagctccacctcctgggttcacaccattctcctgcctcagcctcccgagtatctgggactacaggcgcccgccacaatgccgggctaattttttgtatttttagtagagacggggtttcaccgtgttagccaggatggtctcgatctcctgacttcgtgatctgcccgcctcggcctcccaaagtgctgggattacaggcgtgagccatcgcacccggcctgttttaacattttcataaggtaaaaacctttcttagctcaaaggtctttaaaaaagcaggcaatccagctgggcatggtggctcacgcctgtaatcccagcattttgggaggctgaggtggacagatgacttgaggtcaggagttcaagaccagcctggccaacatagtgaaaccctgtctctactaaaaatacacaaattagccaggtgtggtggcgggggccctgtaatcccagctactcgggaggctgaggcaggagaatcgcttgaacctgggaggcagaggttgcagtaggccaagatcctgctgccactgcactccagcctgggagggtgagactccatctaaaaaaaataaaataaatggcaacccctggtctaagataagagataaaacatcaggtggtgaggttgaggtttggggcttggtagcagttgccccagtcatgagatgactcacttaacccgtctcctttaagtgagctgggctgggaggcttcctacaggggaagaggcccctctggggagctgactcagccaggctccctgaacttttttccttgtcccatcctggggtcaataaaactgaatgttgcatattcta

SEQ ID NO: 204704 - DNA, 2091 bp, Homo sapiens
  Payload ID: 20378
  Gene Name: zinc finger, SWIM-type containing 2
  Uniprot ID: Q8NEG5
  ENST ID: ENST00000295131
  CDS Start-End: 41-1942
agtgagccgagcagaggggccgcctccgcccgcacccagcatgcttcgccgaggctataaggcctctgaaaggcgaagacacttgagcgagaggctcagctggcaccaagaccaggcgctgagtagcagcatctacctcctacgagagatgggccccactggcttcctgctgagggaggaggagccggaatacatggatttccgagtttttctaggaaatcctcacgtttgtaactgttccacatttccgaaaggaggggaactttgtaagcatatctgctgggtcttgttgaaaaaattcaagcttccaaggaaccatgaatctgctttacaactgggtcttggagaaagagagataagtgacttgcttcgggggatacatcgagttcaaactccccaaccaggaacaaatgacgaaaatgaacatgttgaagaagatgggtacattaaacagaaggaaattgattcagaggatatctgctctatttgtcaagagctacttttagagaaaaagcttcctgtcaccttttgcaggtttggctgtggcaatagtattcatataaaatgcatgaagatcttagctaattatcagagtacatcaaacacttccatgttgaaatgtcctctgtgcaggaaagagtttgcaccattaaaactgattttggaggaattcaaaaactctagcaaactagtagctgcagcagaaaaagagagactggacaaacaccttgggattccctgtaataactgcaaacagtttccaattgaggggaagtgttataagtgtaccgaatgcatagaatatcacttatgccaggaatgttttgatagctgctgccatctttcccacacgtttacatttcgtgagaaaagaaaccaaaaatggagatcactagaaaaaagagcagatgaagttgtaaaatacatagatactaaaaatgagattgaagaaaagatgtcacattttcaagaaaagcaaggccaagtttacacaccaaaacacattgtaagatcactgcctctccaactgattactaagaatagtaagctgcttgctccaggctaccagtgtctactttgtttgaaggcatttcatcttggtcaacatacaagattgctaccatgtactcacaagtttcacaggaagtgtattgacaactggttattccacaagtgcaattcatgccctattgatggacaagttatatataaccctttaacttggaaaaattcagcagtgaatggacaagcacatcagtctgtttcaaacagagacatcattcatctatcaaagcagaaagaaccagatctttttattcctggtactggattagtcttaaaacaaaatagacttggaattttacctagcatacctcagtgtaattttgatgaattgaatacacctcaaagcccaaaagatgcctatgaaaatacaacaatagataatctatgctctatcaaattagataattcaaattcaaaaaaattaacctatgattataaaattagccaacattttcccaggtatcttcaagatttacccactgtgtcatttgggaaaataccatctcaaacactgcttcctcctattgttcataagaatattgtgtgtcccactgcaatggaaagtccatgcatcagtggaaaatttcacactagtctaagccggatgaccaaaggctgtaaatgtaataaccacaacctaaagaagactcctgccactaaaataagagaggacaacaagagatcaactttacttccagaggatttcaatcttattgtcaattggagcacagctaaacttagtttgtctaaaaggtatagtaactgtatgggggaaattacacgaaaatgtagtcatctatcaagacagcctgtgtctcactctgtaaatacaaaaagtactgagctatctttaataatagaaggagttcaattgtgaaaaagtttactatctgaaaatatttgaatgttgaatataaaaaaatgttttatatagaacataaaaagcacacatagtcttgacaaatgtatataaaattctctgttggaatttgcctacttacctataaacagctcactacacttaaa

SEQ ID NO: 204705 - DNA, 596 bp, Homo sapiens
  Payload ID: 20378
  Gene Name: zinc finger, SWIM-type containing 2
  ENST ID: ENST00000419862
  CDS Start-End: 79-324
gcctgcacgccgtcgtcttggagaccggctggcgcctcagtgagccgagcagaggggccgcctccgcccgcacccagcatgcttcgccgaggctataaggcctctgaaaggcgaagacacttgagcgagaggctcagctggcaccaagaccaggcgctgagtagcagcatctacctcctacgagagatgggccccactggcttcctgctgagggaggaggagccggaatacatggatttccgagtaactaccgcccctaccgcccccagttggccatcatccccgcccaccaggttcccccactggcatacccaatgtgcgtagccaccatcacaatctctgcggatacttgctgcctcacccccgaaagcgccttcccacgagtgttccagactctaaaatacgtgaaattacagaaggaaatagtatttattagaagtttcttttttggaggttaagaccaaactgcaactcttgtaaaagatgatggctcttgatctttaggcttgaaaatgtttttctaggaaatcctcacgtttgtaactgttccacatttccgaaaggaggggaactttgtaagcatatctgctgggtct

SEQ ID NO: 204706 - DNA, 2773 bp, Homo sapiens
  Payload ID: 20379
  Gene Name: zinc finger, SWIM-type containing 3
  Uniprot ID: Q96MP5
  ENST ID: ENST00000255152
  CDS Start-End: 210-2300
agatagcaaatacacccccttcctcttgtaacccggtcaggcctagggttcctccctgagttccagaataggccacccagttggggcggacccttaaggcattctgggcccacgcctgcctataaaccctcatagtgtgacctttgacccctggtgtgatcttgggcccgggctgggaccagcccctagtgtgggttgtgggggcggccatggagctgggcagctgcttcaagacctatgaggacttcaaggagtgcttcagcgcctacaaaagggagaacaggtgctccttcattctcagggactgcgtctccgtccgcttccacaacctcaaccatggcacctccatccgcgaagacatcctgtatgtgcaggtgaaatttgtctgcattcggacccaatcaaacaggaagagaacgcgggaggcagacatgtgcccagcgtacttgctcctaaggtacaacgagagactagatagactatttatcagtgaactaaacacacagcacatacatggtgactctaaagtggctagtcctggaggagacaccactggcaaatctcaaaagacaatgtgcctgcagagactccagcctgtgcagcccacaaccaaaaaagaccttgacactgccgagaagtccctggttgagccatcgttttgcctagataaggtacaagtgtcctcaaagccagagcaggaaggcatcactccttctgacctggccaagatagcaaaagtgatgaagaactttcttaaggtagatgagggttccatggcttccttcagtgtgggtgacagccagcacctggaccggctcagcttccagagcagtaagatgaccgacctgttcatccgcttcccagagaatctcttgctacaccgggtggagaacacccagggccacatcctctatgctttcttggtggagaacaaggaacgagaaagtcgagtggtgcactttgctgtgctcaaggcggagacagtcacctctgtggccaagatgctgagcatcttcacagagttcaactccgattggcccaaggtcaaggtggtctttgtggacccttcattccattaccgggctatcctgcaggagatctttcctgctgcccgcatcctcctttccatctaccacacaacccgactcttggagaagaagttgcatcgtagttcagcaaatccatcctttaaaaggctcatgaaggaagccctgcgggaggccgtgtttgtcacttctgaagccagcctgaaaaatctctgccagatgtcccaggccgtactggatgaggatctcttcaacttcctgcaggcccactggttcacctgtgaactgctgtggtacatgcatgttaggaagggcctgcttgcgtgtaacacctacatggacagcctagacattgtcaccagcaaggtgtcaagcctctttcgggaacagcagtcgctgctggactgcatcctctgctttgtggattacatagacttctttaataccaaaggcttgaagaacttgcccacacctcctcccaaattaaagagagctcggccggcaagcatgccactgaagtccaagaaggcttttggaatctgtggagagagccttaccagcctccctgcagaagagaccaagccagacgcacagcaggtacaggtacagcagcagtcacaagtgccgccctcgcaggttggcatgctggacaccttgcaccagagtggctctgaactagcctacaagctgtgccacaatgagtgggaggtggtacagaactccacccacctggtggacatggctggctcttcagtggacgttcagctgctagaggactctcaccaggttagcaaagatggctgtagctgcagctgttcctttcaacaatggtaccacctgccatgccgacacattttggctctgctgcacaccagccagcagccggttggtgaagccatggtgtgccgccggtggcagaagaagtaccagtacctccttgggcccaatggggagctccaggatcgtggtatggtcccaaacacaggccagcctgagaagcaaggacggaacgacatgattcaggacctaagcagggagttagcaaacctgctcatgcagaccgaggggccagagctggaggaacgctactccaccctgcgcaagattgtggatatctgggctggcccctcccagccatctgagctctttcagcagccaggagactttaaggacgtgggccgcctccctttcctctggggaaagcaagaagaaggggagggattccctcctgctacagctgtgatgcattattgaagcactttagctgaagcattggaccacaaacacttctccttggaagtgtgagagtttaaagtgggcaggacatactagggtttagcattttagccaatgtcttcctaggtggggctaggaatattgttacagtagagaggaagggaactccactgtgtgacagtcctttcaatctgccccttttcagccctacttttggcattccttgggagcctcagttgttgttcaaggccaaagttatctccgtgctgcaaggtcaccctcttcctcccccagcccctgagatcagatcttatttgctctgcaaagatgaatccctgcctcaggttagggtgagacaaaatcggtctggtaaaagggcctgttttcagggacaaagggaatgaggatgatctttggctgttgctgctctttatgaagaatcttatttgtaactttttattcatattaaagttgtttttaataaaattaaa

SEQ ID NO: 204707 - DNA, 4339 bp, Homo sapiens
  Payload ID: 20380
  Gene Name: zinc finger, SWIM-type containing 4
  Uniprot ID: Q9H7M6
  ENST ID: ENST00000254323
  CDS Start-End: 190-3159
taaaggggccgcatcaccctgccggcccggcgcgggtcgggggtgggtgcggtaggggtcccggggcggccgagcgcagaggacggacgggaaggagggcagggggcgcgggagccggcgaagcggagcgggcatcggaccgagccccccaaagaggccccgccccggccctggccccggccgggccggatggaaccccccgcggccaagcggagccggggctgccccgcgggacccgaggagcgcgatgccggggccggggccgcgcgtggccggggccggcccgaggcgctgctggacctcagcgccaagcgggtagccgagagctgggccttcgagcaggtggaggagcggttctcccgggtgcctgagcccgtccagaagcgcatcgtgttttggtcgtttccacgcagtgaacgggaaatatgtatgtactcgtcgctgggttacccgcccccagagggcgagcacgatgcccgggtgccctttacccgcgggctgcacctgctccagagcggggccgtggaccgcgtgttgcaagtgggattccacctgagcggaaacatccgcgagccagggagtcctggagagcccgagcgcctctaccatgtctccatcagctttgatcgctgcaagatcacgtccgtgagctgcggctgtgacaaccgcgacctcttctactgtgcccacgtggtggccctgtccctgtaccgcattcggcacgcccaccaggtggagctgcggctgcccatctccgagacgctctcccagatgaaccgggaccagctgcagaagttcgtgcagtacctcatcagcgcccatcacactgaggtgctgcccactgctcagcgcttggctgatgagatcctcctgctgggctccgagatcaacttggtgaatggtgccccagaccccaccgccggcgcaggaatcgaggacgccaactgctggcacctggacgaggagcagatccaggagcaggtgaagcagctactgtccaatggcggctactacggggccagccagcagctgcgctccatgttcagcaaggtgcgggagatgctgcgaatgcgggactccaacggggcgcgcatgctgattctcatgaccgagcagttcctgcaggacacgcgcctggccctgtggcggcagcagggcgcgggcatgacggacaagtgccggcagctctgggatgagctgggggccctgtgggtttgcgtcgtcctgagcccccactgcaaaccagaggaaagggcaggctggctccagctactcagcaggtgggacaagctcgacgtctgcccactggaagagggcaactactccttcgacggccccagcctgcagcccaccatggcccccgccccagagctgctccagaagggctccacctgcatcaccaacaccgaaggatgggtggggcaccccctggaccccattggctgcctctgcagggcgctcctggaggcctgtcgtctggaggaggagacacttaccctttacccagactcaggccccgagaagcggaaggtggcctaccagcacgtgcctgtgcccgggagccctggggagtcctacttggtgctggcgctggaggtggcactgctggggctggggcagcagcgggccctgccggaggggctgtacgcccaggacaaggtggtgcgcaacgaggagcagctgctggccctgctggaggaggtggagttggatgagcggttggtgcaggtgctgcgcaagcaggcggggctgctgctggaagggggtcccttcagtggctttggggaggtgctgttccgggagagcgtgcccatgcacacctgtgcccgctacctgttcaccgcactgctgcctcatgacccggacctggcctatcgcctcgcgctgcgagctatgaggctgcccatactggagacagcatttcctgctggagaacctcatcccagcccgctggactccatcatgagcaaccgcttcccccgctggttcatccttggccacctggagacccgccagtgtgaactggcttccaccatgttgacggccgccaagggagaccccaagtggctgcacacggtactgggctccatccagcagaacatccactctccggccctgctctttaagctggcgcaggacgcctgcaagacagccaccccggtcagcgccccaccagacaccacgctgctgggcatcgcactggagctggggctgcaggtgatgcggatgactctgaacgtaatgacctggcggcggagggagatggtgcgctggctggtcagctgtgccacagagattggcccgcaagccctgatgaatatcatgcagaactggtattccttattcacaccagtggaggcggctaccatcgtggcagtgacgggcaccacacacgccactctgctgcgactgcagctggacacatcgcggagggaggagctctgggcctgcgcccgcaccctggccttgcagtgcgcgatgaaggaccctcagaactgcgccttgcctgccctgaccctgtgcgagaagaaccactcggccttcgaggcggcctaccagatcgtgctggacgcggcggccggcggcctgggccacgcccacctcttcactgtggcccgctatatggagcaccgcgggctgccgctccgggcctacaagctggcgacgctggccctggcgcagctcagcatcgccttcaaccaggacagccaccctgccgtcaacgacgtgctttgggcctgctctctcagccactccctgggccggcacgagctctctgccatcgtccccctcatcattcgcagcatccactgtgccccaatgctgtccgatattctgcgccgctggactctctcggcgcccggtctgggccccttaggggcacgccgggccgccaagccactgggtgccgaccgggcgccgctctgccagctcctggacgcggcagtcaccgcctacatcaccaccagccactcgcgcctcacgcacatcagcccgcggcactatggggatttcatcgaattcctgggcaaggcccgggagaccttcctgctggcgcccgacgggcacctccagttctcacagttcttggagaacctcaaacagacctacaagggcaagaagaaactcatgcttttggtgcgggagcgttttggttgagggacagtggggtgcgtgggagtggggatccccctcgcccctgcgtcccccacccttgctctccaattaggcccacgtggcatttcagtattattaagtcagggaaggagcccggctggagatgggggcagggggagcagcatcctgccacgtgtgtgcctgggagtctgtgagcaagtgtgcaagactccagaagcagaagccatactgccacccagaagcctggaaggggtgtgtgcttgggctgctggtatgaccccactttgggcaccccaaaagcaataggcaaactccccttacccagactggcttgggctccaggagggaggctgggaggcaggactttccagaaatcgaccctctaagtcaatgtagcacattttcccccaaccccaccctgggtggccaagggtcctcccccaccccctactgctcagggccccccattatgccacctccaaagtggctgcccagccaggaccattggctcacccccactgaaggaattgaagaggcctcaggcctcagcctcatacctcacccccttatcctatccggccaggacccccatttccttgggcactagggtcccagggtgggctcagggttggggaagtcctcgctgccctctcttctcacctgctagtcactggacgtacaactcaggaactgagcgaggctcacactgccccttccaacctggggttgggggacacagacgcgagagagccggagacccccacccccgatctggaaaggaaagagacctgtatcttggtgtttttctggctttttcaccctttcgcctcctgtctttctgcttcgccccttcatcttactctgtttccatttttcccggcacttacctgcctttctctctgcacctaagtccctgccgccctctctctttggccatccttcctttcccccaccttgacccagggaggagaagggagaacatcacccccccaagtcacccccacatcttttcccttcttgtatattaaggacaaaataccacatcattttgtaactttttttctatttattgaacggtgtattacatgtccttttcctttttttttttcaaagattgaacagaaatttttctttttaattttattttgagactggggtgcatctccagagccactcacaccctcaacctcgtttcctccgc

SEQ ID NO: 204708 - DNA, 719 bp, Homo sapiens
  Payload ID: 20380
  Gene Name: zinc finger, SWIM-type containing 4
  ENST ID: ENST00000592227
  CDS Start-End: 1-719
agccctggccctgtctcccccagactcaggccccgagaagcggaaggtggcctaccagcacgtgcctgtgcccgggagccctggggagtcctacttggtgctggcgctggaggtggcactgctggggctggggcagcagcgggccctgccggaggggctgtacgcccaggacaaggtggtgcgcaacgaggagcagctgctgacccgccagtgtgaactggcttccaccatgttgacggccgccaagggagaccccaagtggctgcacacggtactgggctccatccagcagaacatccactctccggccctgctctttaagctggcgcaggacgcctgcaagacagccaccccggtcagcgccccaccagacaccacgctgctgggcatcgcactggagctggggctgcaggtgatgcggatgactctgaacgtaatgacctggcggcggagggagatggtgcgctggctggtcagctgtgccacagagattggcccgcaagccctgatgaatatcatgcagaactggtattccttattcacaccagtggaggcggctaccatcgtggcagtgacgggcaccacacacgccactctgctgcgactgcagctggacacatcgcggagggaggagctctgggcctgcgcccgcaccctggccttgcagtgcgcgatgaaggaccctcagaactgcgccttgcctgccctgaccctgtgcg

SEQ ID NO: 204709 - DNA, 2921 bp, Homo sapiens
  Payload ID: 20380
  Gene Name: zinc finger, SWIM-type containing 4
  ENST ID: ENST00000590508
  CDS Start-End: 1-2697
agcgcccatcacactgaggtgctgcccactgctcagcgcttggctgatgagatcctcctgctgggctccgagatcaacttggtgaatggtgccccagaccccaccgccggcgcaggaatcgaggacgccaactgctggcacctggacgaggagcagatccaggagcaggtgaagcagctactgtccaatggcggctactacggggccagccagcagctgcgctccatgttcagcaaggtgcgggagatgctgcgaatgcgggactccaacggggcgcgcatgctgattctcatgaccgagcagttcctgcaggacacgcgcctggccctgtggcggcagcagggcgcgggcatgacggacaagtgccggcagctctgggatgagctgggggccctgtgggtttgcgtcgtcctgagcccccactgcaaaccagaggaaagggcaggctggctccagctactcagcaggtgggacaagctcgacgtctgcccactggaagagggcaactactccttcgacggccccagcctgcagcccaccatggcccccgccccaggctcggaggaagaggaagaggtggcagccacaagtccccgccacacggtatttggccgcgccttgctggctggagagctacactggaatgacgcctacctgcagaggatcctggccagtgactcctacgggcccagcctcacaggcagcgtgggtggggacaaaccgactttcgacccccagggccgcccactgtggctgggagaacctttccccactgcctgtgcccgtgtggacaccctgcgtgcccacggatacccccgccaggccctgcggctggcaagtgccatcatcaacacactccggctgcagcagcggcatcagctagagagctacaagcagcagaaaaaagagctgctccagaagggctccacctgcatcaccaacaccgaaggatgggtggggcaccccctggaccccattggctgcctctgcagggcgctcctggaggcctgtcgtctggaggaggagacacttaccctttacccagactcaggccccgagaagcggaaggtggcctaccagcacgtgcctgtgcccgggagccctggggagtcctacttggtgctggcgctggaggtggcactgctggggctggggcagcagcgggccctgccggaggggctgtacgcccaggacaaggtggtgcgcaacgaggagcagctgctggccctgctggaggaggtggagttggatgagcggttggtgcaggtgctgcgcaagcaggcggggctgctgctggaagggggtcccttcagtggctttggggaggtgctgttccgggagagcgtgcccatgcacacctgtgcccgctacctgttcaccgcactgctgcctcatgacccggacctggcctatcgcctcgcgctgcgagctatgaggctgcccatactggagacagcatttcctgctggagaacctcatcccagcccgctggactccatcatgagcaaccgcttcccccgctggttcatccttggccacctggagacccgccagtgtgaactggcttccaccatgttgacggccgccaagggagaccccaagtggctgcacacggtactgggctccatccagcagaacatccactctccggccctgctctttaagctggcgcaggacgcctgcaagacagccaccccggtcagcgccccaccagacaccacgctgctgggcatcgcactggagctggggctgcaggtgatgcggatgactctgaacgtaatgacctggcggcggagggagatggtgcgctggctggtcagctgtgccacagagattggcccgcaagccctgatgaatatcatgcagaactggtattccttattcacaccagtggaggcggctaccatcgtggcagtgacgggcaccacacacgccactctgctgcgactgcagctggacacatcgcggagggaggagctctgggcctgcgcccgcaccctggccttgcagtgcgcgatgaaggaccctcagaactgcgccttgcctgccctgaccctgtgcgagaagaaccactcggccttcgaggcggcctaccagatcgtgctggacgcggcggccggcggcctgggccacgcccacctcttcactgtggcccgctatatggagcaccgcgggctgccgctccgggcctacaagctggcgacgctggccctggcgcagctcagcatcgccttcaaccaggacagccaccctgccgtcaacgacgtgctttgggcctgctctctcagccactccctgggccggcacgagctctctgccatcgtccccctcatcattcgcagcatccactgtgccccaatgctgtccgatattctgcgccgctggactctctcggcgcccggtctgggccccttaggggcacgccgggccgccaagccactgggtgccgaccgggcgccgctctgccagctcctggacgcggcagtcaccgcctacatcaccaccagccactcgcgcctcacgcacatcagcccgcggcactatggggatttcatcgaattcctgggcaaggcccgggagaccttcctgctggcgcccgacgggcacctccagttctcacagttcttggagaacctcaaacagacctacaagggcaagaagaaactcatgcttttggtgcgggagcgttttggttgagggacagtggggtgcgtgggagtggggatccccctcgcccctgcgtcccccacccttgctctccaattaggcccacgtggcatttcagtattattaagtcagggaaggagcccggctggagatgggggcagggggagcagcatcctgccacgtgtgtgcctgggagtctgtgagcaagtgtgcaagactccagaagcagaagccatactgccacccagaagcct

SEQ ID NO: 204710 - DNA, 5819 bp, Homo sapiens
  Payload ID: 20381
  Gene Name: zinc finger, SWIM-type containing 5
  Uniprot ID: Q9P217
  ENST ID: ENST00000359600
  CDS Start-End: 207-3764
ctgcaggccgcccgcgtctgccctcgcggcgcgctcccgggcccggccgcggttccccactcgggccggctggctcgcgggttctctcgccccgcccccctcggcgccaccgctgggcgcttgcgcggggcgcgtggccgtggccagggtctccgccgcagcccgagcagccgccgccgcctcagtcagtcagtcagtccccagcaatggcggacggaggtgagcgagaggagctgctctcgccgtcaccggtctctccggctaagcggcagtgttcgtggcccagcccgcaggctcatcaccctcgcggttcgcctggggcagccggcggaggggcagggggcgtcggcagcagctgcctggtcctcggggcccgcccccacctgcagccggattccttactggactgcgccgccaagacggtggcggaaaagtgggcatacgaacgggtggaggagcgcttcgagcggatcccggagcccgtgcagcgccgcatcgtctactggtccttcccgcggaatgagcgggagatctgcatgtactccagcttccagtaccggggcggccccggcgccggcgctgctggcggcgccgcgggggcttcgccggccgaggaggggccgcagccaccccccggggccgccgctccggccggctccgcccccgggggcgtcgcggctggggcatcccccgggctgggcgcaggggccggcgcggccggctgcggtggcgaggggctcccgttccgccggggcatccgtctgctggacagcggctccgtggagaacgtgctgcaagtcggctttcatctgagtggcacagtaactgagctggccactgcctctgaaccagcagtgacttataaagttgcaatcagttttgatcgatgcaaaatcacctcagtgacatgtggctgtgggaacaaggacatattctactgtgcccatgtggtagcactctcactctacaggatccgtaaaccagaccaagtcaaattgcgtcttcctatctccgaaacccttttccagatgaatagggaccagctacaaaagtttattcaatatttaatcacggcacaccacactgaagttcttcctactgcacagaaactggcagatgagattctatcctccaactcagaaatcaaccaagtgaatggtgcccctgaccccacagctggggccagcattgacgatgagaactgttggcatttggatgaagaacaggtgaaagaacaagtgaagctttttctctcccagggcggttactgtggctctggaaagcaactcaactcaatgtttgccaaggttcgagaaatgctgcggatgagagattccaatggagcaaggatgctgacactaataactgagcagtttgtggctgacccacgactcacactctggaggcagcaaggaacaaacatgacagacaagtgcaggcagctctgggatgagctaggggctttatgggtgtgcataattttaaatccacactgcaaactggaggagaaatcctgctggctgcagcagctgcagaagtggagcgacctggatgtctgtcccctggaggatggaaactatggacatgagctgcccaacatcaccaatgcacttccccagagtgccattcacagcccagactccttatccagaccaagacgaacagtattcactagagccattgaggggcgtgaattacattggcaggatagccacctacagcgaataatcagcagtgatgtttatacagctcctgcctgccagcgggaaagtgaaagactactctttaattcccaaggccagccactgtggcttgagcatgtgcctacagcctgtgctcgagttgacgccctgcgttcccatggttatccaaaagaggccctcagactcacagtggccattattaatactctgaggttgcagcagcagcggcaactggaaatctacaagcatcagaagaaagaactgttgcagagaggaaccacaaccatcacaaacctggagggctgggtgggccaccccctggatcccatcgactgcctgtttctcactttgactgaggcctgccgcctgaatgatgatggctatctggagatgtcagatatgaatgaaagcagaccccctgtgtaccagcatgtacctgtggctgcaggctccccaaacagcagtgagtcctacctgtcattggccctggaagttgcactgatgggcctgggtcaacagaggttaatgcctgaaggcctctacgcacaggacaaggtatgccgtaatgaggagcagctcctgagccaactccaagagctgcagctggacgatgagctagtgcaaacactgcaaaaacaatgcatcttactgctggaaggaggtcctttcagcggtctgggagaagtcatccaccgagagagtgttcccatgcatacctttgccaagtatttgttctcagctctgctgcctcatgatccagacctgtcctataaattagccttacgtgccatgaggttacctgttttagaaaactcagcttctgcaggcgacacatcccaccctcaccatatggtgtctgtggtgcccagccgttatcctcgctggttcacgcttggacacttggaatcacagcagtgtgaactggcctccaccatgctgactgctgccaaaggagacactttgagactccgaacaattctggaagcaatacagaagcacattcattcttcctccctcatcttcaaactggcccaagatgcattcaagattgctactcccaccgacagtagtactgacagcaccctgctcaacgttgccctggaacttgggttacaggtgatgcggatgaccttatcaacccttaactggagacgcagggagatggtacgatggttggtgacctgtgctacagaagtgggtgtgcgggccctggtgagcatcttgcagagctggtacacactcttcacccctactgaggctactagtattgtagctgccacagccgtatcccacaccactatcctgcgcctcagtcttgactatccacagcgggaggaactggctagctgtgctcgcacactggctctacagtgtgctatgaaggatccacagagctgtgccctgtcagcccttacactctgtgagaaagaccacattgcctttgaggcagcctaccagattgccattgatgctgctgctggtggtatgacccattcacagctgttcaccatcgcccgctacatggagctccgtggctacccgctacgtgccttcaagctggcctcattggccatgagccatcttaacctggcctacaaccaggatactcacccagccatcaatgatgtgctctgggcttgtgctctcagccactctctgggcaagaatgagctggcagctctcatccccctggtggtgaagagtgtgcactgtgccacagtgctttcagacatcttacgacgctgcacagtgactgcacctggcctggccggcatcccaggccgccgaagctctggaaagctcatgtccactgacaaagctccattgcgccagttgctggatgccaccatcaatgcctatatcaacactacacactcacgcctaacacacatcagccctcgccactatggagagttcattgagtttctaagcaaggctcgggagaccttcctgctgccccaggatggccacctgcagtttgcccagttcatcgacaacctcaaacagatctacaaaggcaagaaaaagttgatgctgctggtgcgagagcgctttggctgagagagcagatagctcactgccagagcagcctgggttcccaggtagtatcaggtcaggccaagggcactgaaacatttgtccaccctgagagaactctgagcacctgtggatgaggccaaaggaccacagggctaaggatggggaaagtccagctctagtcgataatgcctaccttggcaagcttctgactacagcctactgttcatggaggagctgggccctgcagatcgaccagaaaccccacaacatgccacctcatgcccctatatcctgcgtgtcctgagcattggccctgtctcccttggcaaacacagaacactgttccatctcagggattgcttaaccagagaaacagacacatttgtgggactgtaaatactatatgtgttgctaattattgtaaacttgtaactatttataattctgcttctgatttgatgggcacttgaagtagctgtgggtaggaggatatgcttattttctgaggagactcacaaccatttctcaggtttcccttgcagagtgtttgctggtagcagtggaagagtgggggtgccaaggagaaaaatggccagttaggatcaacccaagtctagtctatgcagaatcccccacctacagacagggcatttatagtccagtggtgagtgagggacagaggccaggactggacttagacttttgcctcacaaaactgtgaggacattgaagctcctgcctcacacagcctcttcaggagcctgctgaacacctgagaaacaagtgcagggagaagatgaaggtctgggaagccgctgagttcataatattcatctactgtggtcacctttgtgttagcaagtgtgtggtttcatctataattgtgtgtgtgtatctttatggctaagtacatgtgtgtatgtacatagatacatctgtgcatgcctgtttgtgcacatatatatttatgtgtatgtgtcagttctatggctgtgtacctgtttgaatatgtgcacactggactgtgagtttctacgtgaggatatacacattttgtgtacatgtgaggatgcacatctttgtgcaaatgcactcatgtttgtgcatgtttagtatgtgtatctgcgtacacgagtgcatgtgtataaacatgtttgtatccatgtgtatgcttgttatccatgcatctgtgtctttatatgtgtaactgagcgtatttctacatgtagggatgtctgtgtattcatgtttgaggatctgcatcaatgtgtcctttttgccagatttctctttcccattcctcttaaatctctctcgccagctaaacgtttgttccccatctctgtgcctcctctattcattctctcaccaaacaagcttctaagcaccaatctccctctgccatcagattggctgctttagctccatagttctcttctcgcctcatacttgctttcttcccctgcctttctacctcaagcttcctcgccggcttttgtcacagtctcattgctcgctgacttggaggctagggctggtctgcacttagcctctcccttcctaatttctagccctagtgggcagtcctgtcttagccctggctgacctccatagtgtatcatgttcctgctaccttcctgacccctgtgctcagcctggaattgttataggaggtagcaagggcactcagaaaagtcagttggaaccagtgtcttggtgtttactgtttcatgtcttagttcctgagttgggggtggggtttgatagggaaggggtggtatagctagaatgtgaactaagaacttctccatctgctttactttttctttcttcgacaaactgtcaccttttttactccaaactgaccaagaagttgtatttgccatttgtggctactcaagtcttactgtccagccaagggcccctacgtctcagcccaatgggttggttaaaaaaaagagagaagccactctcatttctgtatcacagttgcccttttttagcaagtgtgtgaattcacagtgcttttctatgaataaatcatggatcacataaaagatcatttttctaaaagca

SEQ ID NO: 204711 - DNA, 5501 bp, Homo sapiens
  Payload ID: 20382
  Gene Name: zinc finger, SWIM-type containing 6
  Uniprot ID: Q9HCJ5
  ENST ID: ENST00000252744
  CDS Start-End: 1-3648
atggcggagcgcggacagcagcctcctcccgcgaaacggctttgctgccggccgggcggcggcggcggcggcgggggcagcagcggcggcggcggcggcgcgggtggcggctacagctctgcctgtcggccaggcccgcgggcgggtggcgcggcggcggcggcggcgtgcgggggcggcgcggcgctggggttgctgccgccgggcaagacccagagccccgagtcgctgctggacatcgcggcgcgcagggtggcggagaagtggccgttccagcgcgtggaggagcgctttgagcgcatcccggagccggtgcagcgccgcatagtctattggtccttcccccgcagcgagcgggagatctgcatgtactcgtccttcaacaccggcggcggcgccgcgggcggccccggcgacgacagcggtggcggcggcggcgcgggcggcggcggcggcggcggctcctcgtcttccccggccgcaacctcggcggccgcaacctcggccgccgccgccgctgccgccgccgccgccgccgccgccgccgccgcgggggccggggccccgtcggtgggggctgccggggcggcggacggcggcgacgagacgcggctgcctttccgccggggcatcgcgctgttggaaagcggctgcgtagacaacgtcctgcaagtcggtttccacttgagcggcacagtgacagaacctgcaatacaatcggagccagaaactgtttgcaacgtggccatcagctttgatcgttgcaagattacctcagtgacctgcagctgtggaaacaaggacatattttattgtgcccatgttgtggcactgtctttataccgcatccgcaagccagatcaggtcaaactgcatcttcctatttcagagactctctttcaaatgaatagagaccaactgcaaaagtttgtacagtatttgatcacagtgcaccacacagaagttttgccaactgctcaaaaattagcagatgaaattctttcccaaaattcagaaatcaaccaagttcatggtgctcctgatccaacagcaggtgctagtatagatgatgaaaactgctggcacttagatgaagagcaggttcaagaacaggttaaactgttcctttcccagggcgggtaccacggatcagggaagcagcttaatttgctctttgcaaaggtgcgggagatgttaaagatgagggactccaatggggcccgcatgttgaccttgataacagagcaattcatggctgaccctcgcctgtcactttggcggcaacaaggcactgcaatgactgacaaatacaggcagctctgggatgagctgggtgctctgtggatgtgtatagttttaaacccccactgcaagttggagcaaaaggccagttggctaaaacagctgaagaaatggaatagtgttgatgtctgtccatgggaagatggaaatcatggcagtgaattacccaacttaaccaatgctctgcctcagggtgcaaatgccaaccaagattcatcgaacaggccacatcggacagtgttcacccgagccatcgaggcatgcgatctccactggcaggatagccacttgcagcacattatcagcagtgacctatacaccaactactgttaccatgacgacactgaaaactccctcttcgactcccgcgggtggcccctctggcatgaacatgttcctacagcctgtgcaagagtggacgcattacgttctcatgggtaccccagagaagcactgagactagcaatagctattgttaatacattaagacgacagcagcagaaacagttggaaatgttccgaacccaaaaaaaagagctaccccataaaaacataacctcgataaccaatctggagggctgggttggacatcccctggaccctgtgggcactctcttcagtagccttatggaagcctgccgcattgatgatgagaacctctctgggttctcagattttacagagaatatgggacagtgcaagtctctggaataccagcatctacctgcacacaaattcttagaagaaggggaatcctatttaacgctggctgtggaagtagccctgatagggctaggacagcagcgtatcatgcctgatgggctgtacacacaagagaaagtttgccggaatgaggagcagctcatttctaagcttcaggaaattgaattggatgacacactggtgaaaatttttcgcaagcaagcagtcttcctattagaagccggaccatatagtggtttaggtgaaataatccatcgggagagcgttccaatgcacacatttgccaagtatctcttcacctctctcctacctcacgatgctgaattggcatacaaaattgcactgagagcaatgcggttactagtattggaatctactgctccatcaggagacctcacccgcccacaccacattgcatcagttgttcccaaccgctaccctcgctggttcactctaagccacattgagtcccagcagtgtgagctggcatccaccatgctaactgcagccaaaggcgatgttcggaggctggaaacagtattagaatccatccagaaaaacattcactcctcatcacacatcttcaagcttgcccaagatgcatttaaaatagcaactctcatggacagtttgccagacatcactcttttgaaagtgtctctggagctgggcctgcaggttatgcgaatgacactgtcaaccttaaattggcgacggcgggagatggtgaggtggctggtaacgtgtgctactgaagtcggggtttatgccctggacagcatcatgcagacctggtttacactctttactcccaccgaggccacaagtatagttgcaactaccgtgatgtccaacagcaccatcgtccgcctccacctggactgccaccagcaggaaaagctggccagcagcgcccggacacttgcactgcagtgtgccatgaaggatccacagaactgtgccctctctgcgctaaccctttgtgaaaaggatcacatagcttttgagacggcgtaccaaattgttctcgacgctgctacgactggcatgagctatacacagctctttacaatagcacggtacatggagcaccgcgggtaccccatgagggcctacaagctggccaccctggccatgacccatctcaacctgagctacaatcaggacacacaccctgccattaatgatgttttgtgggcctgtgcgcttagccactcccttggtaaaaatgagcttgcagctataatacctctggtggtcaagagtgtcaagtgtgcaacggtactgtcagacattttgcgcagatgcactctgaccactcctggcatggtgggacttcatgggaggaggaactctggtaagctcatgtcactggacaaagcccccttgaggcaactcttggatgccacgatcggggcctacatcaacacaacgcactcacggctcacacacatcagtcctcggcactatagtgagtttatagagttcctcagcaaagcccgagagaccttcttaatggcgcatgatggacacattcagtttacacagtttattgacaacctgaaacaaatctacaaaggcaaaaagaaactgatgatgttggttcgggagaggtttggttgatagatcttgtatgaatggggtggggggtggggatgggagggatggtttgtttttacttgagcctgcctttgtaccctttttaacttaaagaacagagccacaccggtattatatgtgtatagttatattgcgtttgcagactaaattgtcatgttgtgaaagtttgtgtgttttttattttttccctatttctttctttcctttattttattattttttttaattttttttttctggttttgtatgagagagaggttaaaaaggtttggtttacactgagtatatgttgtcaagtggcaaaagtccacatagctctcctgttttctgtatacgttcacagcctcaaaaaaaataattgaaatggctttaaaaaccaaacaaaacacctccatcctgtgataagtacctcgaatggattcagctttactcctttgtaactcatctttacattttcagcatatttaaacaaaccaacaaaatgaaatactaatagtaaaaaggctgacccatgtggctttgcagtgctgttcgtccagaagcatggcacacgatgcttgtgcatgtggaaacttagcgactgtcaacatacattctcagggatttatccaaaaaaattaaaaaaagaatgagagcatttattgtactgtatatatattatagtatatgtctgaatattgaaaatataacattaactaatttataaaaaatattctatgtaatgcaaaatacttgaagctgcagtagcttggttttaaacaaaaacaaaaaaaaaactgagagaaaacctatcagaaggactaaaagtacgccttgcttcagggttggctcaggtggtgaacttcatgctgggcatctatgcagagccaccttttggattgcatggttggactgagatctattgggagaaattatatatgtatatatatttatacaacttatgtatacatatatatatgtatacacacagacacacacacacaccaccaacaaccaccactacaccacacatgcttataacaggcactagaataaagagggacaacaaaatacacagccagagcagcaagccttagcattaagaatatacaatatgccggaattggggttcgtgcctcctagcctaggaaacttaaaagaaatatccttttgacacaaaacacaaaatgttttccaaaacaattgacataatgatacattacgcctttgcagtgagctaataataagctaacctttgtgcacaaataacattatatatattatatatctattctgcataggtattttgactttgtgcaggacagaaagttgtgtaggtatgactgttctacttttcagttttctttttttttaatatattttattttctctagaaattactcaaacaaaagcagccttctatcttgccttgtcttaatgctttaaaataaccaaactggagatctaactaccaaactgttcattatattattaaataccaactttggttacagtatagtgtctttactttagctgatggttctgtaaccttgtgctttttaaagcaatttttatgttttggtgcaaaagttgtccagtgtctcttgttcccttcactagagaacatgcttagaggtatgtttgtaggtatttttgtttagaagaactatttcatgcgctccattttatttattataataggtaaaaagaaaaaaaaaggttgtaattcatcacccatgtaaacatgctcatgaagttgaaagtaattaagatttgatacactgatatcaatttatttatgtaactaaatcactgttttataaacttgttaatgatcaacaatttttgttttgattaaaattagttttttgaaagtt

SEQ ID NO: 204712 - DNA, 2008 bp, Homo sapiens
  Payload ID: 20383
  Gene Name: zinc finger, SWIM-type containing 7
  Uniprot ID: Q19AV6
  ENST ID: ENST00000399277
  CDS Start-End: 99-521
cctgccccggcggggggtcaggatcctccacaggtaggcgcagtcagctggagcgtcgcggcggtccgccggtcgtggagggcgtgtcctgcggcgcgatggccgtagtgttgccggcggttgtggaggagctcctgagcgagatggcggcggcggtgcaggagagcgcgcgaattcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggtacagattgagcatcattctttcaaaatagaatcctgtcaagaaatgcattgaaagcgtcatgattcacatggaaaagaggtgaaatggatcttcagacacttcatgttactgtcccttttccctccaggactgcaggaggtgctgtgggttggagccgtgggctgtggagggtttgtgtatgatgagaagccctgtacagtcttgtcaagaaataccctgagccagtctctgagacgcttcggtaaaaaatgtccctggatggaatcaagattttaaattcaaataaagcctaatatcatgttgtgtccacattatttagtctttttttttttcttttgagatggagtctcactttgtcgcccaggctggggtgcagtggcgtgatctcagctcactgcaagctccgcctcccgggttcacgccattctcctgcctcagcctcccgagtagctgggactacaggtacccgccaccatgcccggctaaatttttgtattttttttttagtagagatggggtttcaccgtgttagccaggatggtctccatctcctgacctagtggtctgcccgcctcgacctcccaaagtgctggaattacatgcatgagccactgcgcctgaccctatttagtcttaagtaactaactgaattactagtaatttttaaaaggttggaatggtgggccaaacagtaagatgaagtttcgacgagtaggtcagttcttttccttgggtccaggaaactattgagcagcaacagaagatcagagcagagatgtggctaaacagtagcaggtatgaaaagacttagaggttctggtttctgtaagcttcaaatatctgtgatgcttgtgccaaaacagcttaagtagactgtattgtttgagagttagtatcgagaacaagggaagaactggtttcactctgcacttctgatctttacaacagggcaattgaaggaacagactaaaaatcgtgtcctggaaggaaactacaggtactaccagggattttcagtctgaagaagaaaagacaaaatagatgacagaaggagtattagaagggagagcgatgagactcagttggacaccgagagagcaaagaagcaataatacgtgaagatgaaaatgaaatcaatttcagcataagaagacaagaacttatggtaaagctgcccacagccagaagaggatcctagaaggacaggaattccctgtctgcagcatttcataagcatgtaatattgttgcagggatactgcagaaggagttgaagcagtggacagacagatgatataggtgattttacagcctaagaaagccctgtgcttgtgcccccaaaacatgaggtgctagtgaatgaatgctgggggaaagcccagggcctaggtgttgcaatgttctgtggttggcagatgctttttgttttgttaaaaagtgcaacagataaaatttatcaatacttttctgctactcaggaaa

SEQ ID NO: 204713 - DNA, 703 bp, Homo sapiens
  Payload ID: 20383
  Gene Name: zinc finger, SWIM-type containing 7
  Uniprot ID: Q19AV6
  ENST ID: ENST00000472495
  CDS Start-End: 91-513
ggcggggggtcaggatcctccacaggtaggcgcagtcagctggagcgtcgcggcggtccgccggtcgtggagggcgtgtcctgcggcgcgatggccgtagtgttgccggcggttgtggaggagctcctgagcgagatggcggcggcggtgcaggagagcgcgcgaattcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggactgcaggaggtgctgtgggttggagccgtgggctgtggagggtttgtgtatgatgagaagccctgtacagtcttgtcaagaaataccctgagccagtctctgagacgcttcggtaaaaaatgtccctggatggaatcaagattttaaattcaaataaagcctaatatcatgttgtgtccacatta

SEQ ID NO: 204714 - DNA, 969 bp, Homo sapiens
  Payload ID: 20383
  Gene Name: zinc finger, SWIM-type containing 7
  ENST ID: ENST00000476496
  CDS Start-End: 1-93
gtagtgttgccggcggttgtggaggagctcctgagcgagatggcggcggcggtgcaggagagcgcgcgaagtacgggaccgaggtcttcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaagggcaattgaaggaacagactaaaaatcgtgtcctggaaggaaactacaggtactaccagggattttcagtctgaagaagaaaagacaaaatagatgacagaaggagtattagaagggagagcgatgagactcagttggacaccgagagagcaaagaagcaataatacgtgaagatgaaaatgaaatcaatttcagcataagaagacaagaacttatggtaaagctgcccacagccagaagaggatcctagaaggacaggaattccctgtctgcagcatttcataagcatgtaatattgttgcagggatactgcagaaggagttgaagcagtggacagacagatgatataggtgattttacagcctaagaaagccctgtgcttgtgcccccaaaacatgaggtgctagtgaatgaatgctgggggaaagcccagggcctaggtgttgcaatgttctgtggttggcagatgctttttgttttgttaaaaagtgcaacagataaaatttatcaatacttttctgctactcaggaaa

SEQ ID NO: 204715 - DNA, 723 bp, Homo sapiens
  Payload ID: 20383
  Gene Name: zinc finger, SWIM-type containing 7
  ENST ID: ENST00000460315
  CDS Start-End: 95-193
ccccggcggggggtcaggatcctccacaggtaggcgcagtcagctggagcgtcgcggcggtccgccggtcgtggagggcgtgtcctgcggcgcgatggccgtagtgttgccggcggttgtggaggagctcctgagcgagatggcggcggcggtgcaggagagcgcgcgaagtacgggaccgaggtcttcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggactgcaggaggtgctgtgggttggagccgtgggctgtggagggtttgtgtatgatgagaagccctgtacagtcttgtcaagaaataccctgagccagtctctgagacgcttcggtaaaaaatgtccctggatggaatcaagattttaaattcaaataaagcctaatatcatgttgtgtccacatta

SEQ ID NO: 204716 - DNA, 879 bp, Homo sapiens
  Payload ID: 20383
  Gene Name: zinc finger, SWIM-type containing 7
  ENST ID: ENST00000491631
  CDS Start-End: 124-219
gcgccccgacgtcactccgtctcgccctgccccggcggggggtcaggatcctccacaggtaggcgcagtcagctggagcgtcgcggcggtccgccggtcgtggagggcgtgtcctgcggcgcgatggccgtagtgttgccggcggttgtggaggagctcctgagcgagatggcggcggcggtgcaggagagcgcgcgaagtacgggaccgagttcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggtacagattgagcatcattctttcaaaatagaatcctgtcaagaaatgcattgaaagcgtcatgattcacatggaaaagaggtgaaatggatcttcagacacttcatgttactgtcccttttccctccaggactgcaggaggtgctgtgggttggagccgtgggctgtggagggtttgtgtatgatgagaagccctgtacagtcttgtcaagaaataccctgagccagtctctgagacgcttcggtaaaaaatgtccctggatggaatcaagattttaaattcaaataaagcctaatatcatgttgtgtccacatta

SEQ ID NO: 204717 - DNA, 918 bp, Homo sapiens
  Payload ID: 20383
  Gene Name: zinc finger, SWIM-type containing 7
  ENST ID: ENST00000486706
  CDS Start-End: 76-171
tcctccacaggtaggcgcagtcagctggagcgtcgcggcggtccgccggtcgtggagggcgtgtcctgcggcgcgatggccgtagtgttgccggcggttgtggaggagctcctgagcgagatggcggcggcggtgcaggagagcgcgcgaagtacgggaccgagttcctgatgaatatctgttatcgctgaagtttctctttggctcatcagccacccaggccttggacctagttgatcgacagtccatcaccttaatctcatcacccagtggaaggcgtgtttaccagagacagggtctcactatgttgcccaggctggtctcaaactcctaggttcaagcgatcctcccaccttggcctctcacaatattgggattacaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggtacagattgagcatcattctttcaaaatagaatcctgtcaagaaatgcattgaaagcgtcatgattcacatggaaaagaggtgaaatggatcttcagacacttcatgttactgtcccttttccctccaggactgcaggaggtgctgtgggttggagccgtgggctgtggagggtttgtgtatgatgagaagccctgtacagtcttgtcaagaaataccctgagccagtctctgagacgcttcggtaaaaaatgtccctggatggaatcaagattttaaattcaaataaagcctaatatcatgttgtgtcc

SEQ ID NO: 204718 - DNA, 566 bp, Homo sapiens
  Payload ID: 20383
  Gene Name: zinc finger, SWIM-type containing 7
  ENST ID: ENST00000579955
  CDS Start-End: 91-327
ggcggggggtcaggatcctccacaggtaggcgcagtcagctggagcgtcgcggcggtccgccggtcgtggagggcgtgtcctgcggcgcgatggccgtagtgttgccggcggttgtggaggagctcctgagcgagatggcggcggcggtgcaggagagcgcgcgaagtacgggaccgaggctgaagtttctctttggctcatcagccacccaggccttggacctagttgatcgacagtccatcaccttaatctcatcacccagtggaaggcgtgtttaccagagacagggtctcactatgttgcccaggctggtctcaaactcctaggttcaagcgatcctcccaccttggcctctcacaatattgggattacaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacat

SEQ ID NO: 204719 - DNA, 677 bp, Homo sapiens
  Payload ID: 20383
  Gene Name: zinc finger, SWIM-type containing 7
  ENST ID: ENST00000584519
  CDS Start-End: 43-123
cgcggcggtccgccggtcgtggagggcgtgtcctgcggcgcgatggccgtagtgttgccggcggttgtggaggagctcctgagcgagatggcggcggcggtgcaggagagcgcgcgaagctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggactgcaggaggtgctgtgggttggagccgtgggctgtggagggtttgtgtatgatgagaagccctgtacagtcttgtcaagaaataccctgagccagtctctgagacgcttcggtaaaaaatgtccctggatggaatcaagattttaaattcaaataaagcctaatatcatgttgtgtccacattatttagtctttttttttttcttttgagatggagtctcactttgtc

SEQ ID NO: 204720 - DNA, 987 bp, Homo sapiens
  Payload ID: 20383
  Gene Name: zinc finger, SWIM-type containing 7
  ENST ID: ENST00000585208
  CDS Start-End: 41-136
cggcggtccgccggtcgtggagggcgtgtcctgcggcgcgatggccgtagtgttgccggcggttgtggaggagctcctgagcgagatggcggcggcggtgcaggagagcgcgcgaagtacgggaccgagttcctgatgaatatctgttatcacagtgtctcactctgtcactgaggctggagtacagtggcgcgatctcaactcactgcagcctctgcctcccaggttccagtgattctcctgcctcagcctcctgagtagctgggactacaggtggcacacaccgaggcaggtggatgatgaggtcaggagttccgcctgccttggcctcccaaggtgctgggattacaggcatgagccaccacacctggccttaaaaaaattcttaaaggctgaagtttctctttggctcatcagccacccaggccttggacctagttgatcgacagtccatcaccttaatctcatcacccagtggaaggcgtgtttaccagggtctcactatgttgcccaggctggtctcaaactcctaggttcaagcgatcctcccaccttggcctctcacaatattgggattacaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggactgcaggaggtgctgtgggttggagccgtgggctgtggagggtttgtgtatgatgagaagccctgtacagtcttgtcaagaaataccctgagccagtctctgagacgcttcggtaaaaaatgtccctggatggaatcaagattttaaattcaaataaagcctaatatcatgttgtgtcc

SEQ ID NO: 204721 - DNA, 726 bp, Homo sapiens
  Payload ID: 20383
  Gene Name: zinc finger, SWIM-type containing 7
  ENST ID: ENST00000486655
  CDS Start-End: 41-241
cgtagtgttgccggcggttgtggaggagctcctgagcgagatggcggcggcggtgcaggagagcgcgcgaattcctgatgaatatctgttatcgctgaagtttctctttggctcatcagccacccaggccttggacctagttgatcgacagtccatcaccttaatctcatcacccagtggaaggcgtgtttaccagagacagggtctcactatgttgcccaggctggtctcaaactcctaggttcaagcgatcctcccaccttggcctctcacaatattgggattacagtgcaagcatctcttggcagtttacctgagtcaggttatgaggacctgtcagcagctaagtgtctctgacaagcagttgactgacatattattgatggagaagaaacaagaagcataaaaggtacagattgagcatcattctttcaaaatagaatcctgtcaagaaatgcattgaaagcgtcatgattcacatggaaaagaggtgaaatggatcttcagacacttcatgttactgtcccttttccctccaggactgcaggaggtgctgtgggttggagccgtgggctgtggagggtttgtgtatgatgagaagccctgtacagtcttgtcaagaaataccctgagccagtctctgagacgcttcggtaaaaaatgtccctggatggaatcaagattttaaattcaaataaagcctaatatcatgttgtgtccacatta

SEQ ID NO: 204722 - DNA, 682 bp, Homo sapiens
  Payload ID: 20383
  Gene Name: zinc finger, SWIM-type containing 7
  ENST ID: ENST00000460252
  CDS Start-End: 88-186
ggggggtcaggatcctccacaggtaggcgcagtcagctggagcgtcgcggcggtccgccggtcgtggagggcgtgtcctgcggcgcgatggccgtagtgttgccggcggttgtggaggagctcctgagcgagatggcggcggcggtgcaggagagcgcgcgaagtacgggaccgaggtcttcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggtacagattgagcatcattctttcaaaatagaatcctgtcaagaaatgcattgaaagcgtcatgattcacatggaaaagaggtgaaatggatcttcagacacttcatgttactgtcccttttccctccaggactgcaggaggtgctgtgggtt

SEQ ID NO: 204723 - DNA, 671 bp, Homo sapiens
  Payload ID: 20383
  Gene Name: zinc finger, SWIM-type containing 7
  ENST ID: ENST00000474716
  CDS Start-End: 46-141
cgtcgcggcggtccgccggtcgtggagggcgtgtcctgcggcgcgatggccgtagtgttgccggcggttgtggaggagctcctgagcgagatggcggcggcggtgcaggagagcgcgcgaagtacgggaccgagttcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggactgcaggaggtgctgtgggttggagccgtgggctgtggagggtttgtgtatgatgagaagccctgtacagtcttgtcaagaaataccctgagccagtctctgagacgcttcggtaaaaaatgtccctggatggaatcaagattttaaattcaaataaagcctaatatcatgttgtgtccacatta

SEQ ID NO: 204724 - DNA, 1264 bp, Homo sapiens
  Payload ID: 20383
  Gene Name: zinc finger, SWIM-type containing 7
  ENST ID: ENST00000490395
  CDS Start-End: 57-152
gtcagctggagcgtcgcggcggtccgccggtcgtggagggcgtgtcctgcggcgcgatggccgtagtgttgccggcggttgtggaggagctcctgagcgagatggcggcggcggtgcaggagagcgcgcgaagtacgggaccgagttcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggactgcaggaggtgctgtgggttggagccgtgggctgtggagggtttgtgtatgatgagaagccctgtacagtcttgtcaagaaataccctgagccagtctctgagacgcttcgatggagtctcactttgtcgcccaggctggggtgcagtggcgtgatctcagctcactgcaagctccgcctcccgggttcacgccattctcctgcctcagcctcccgagtagctgggactacagggcaattgaaggaacagactaaaaatcgtgtcctggaaggaaactacaggtactaccagggattttcagtctgaagaagaaaagacaaaatagatgacagaaggagtattagaagggagagcgatgagactcagttggacaccgagagagcaaagaagcaataatacgtgaagatgaaaatgaaatcaatttcagcataagaagacaagaacttatggtaaagctgcccacagccagaagaggatcctagaaggacaggaattccctgtctgcagcatttcataagcatgtaatattgttgcagggatactgcagaaggagttgaagcagtggacagacagatgatataggtgattttacagcctaagaaagccctgtgcttgtgcccccaaaacatgaggtgctagtgaatgaatgctgggggaaagcccagggcctaggtgttgcaatgttctgtggttggcagatgctttttgttttgttaaaaagtgcaacagataaaatttatcaatacttttctgctactcaggaaa

SEQ ID NO: 204725 - DNA, 6062 bp, Homo sapiens
  Payload ID: 20384
  Gene Name: zinc finger, SWIM-type containing 8
  Uniprot ID: A7E2V4
  ENST ID: ENST00000398706
  CDS Start-End: 256-5784
gccgccgagcgcttcgtcccggccctaagtctcggagactggccaagatcaccgcttgcaccgcgctgttgggcgaggcccggtcccgtctctttcccaggcctgagattctcgcccggcacggccgccctgagcgccccggccacccccagccccggctcgcccctcaggccccgggcctcccctcaacccccggccggcggcccaggccccggatccgcggggggggacccggccccggggggtgcgggccccatggagctgatgtttgcagagtgggaggacggagagcgcttctcattcgaggattcggaccgttttgaggaggattcactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagtggtttctcccacaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctgtatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactctagtcg

SEQ ID NO: 204726 - DNA, 5773 bp, Homo sapiens
  Payload ID: 20384
  Gene Name: zinc finger, SWIM-type containing 8
  ENST ID: ENST00000433366
  CDS Start-End: 197-4207
accgcgctgttgggcgaggcccggtcccgtctctttcccaggcctgagattctcgcccggcacggccgccctgagcgccccggccacccccagccccggctcgcccctcaggccccgggcctcccctcaacccccggccggcggcccaggccccggatccgcggggggggacccggccccggggggtgcgggccccatggagctgatgtttgcagagtgggaggacggagagcgcttctcattcgaggattcggaccgttttgaggaggattcactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagtggtttctcccacaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtcagtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctgtatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggccttgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacaga

SEQ ID NO: 204727 - DNA, 3611 bp, Homo sapiens
  Payload ID: 20384
  Gene Name: zinc finger, SWIM-type containing 8
  ENST ID: ENST00000412198
  CDS Start-End: 1-3338
cgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagtggtttctcccacaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctgtatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactct

SEQ ID NO: 204728 - DNA, 4490 bp, Homo sapiens
  Payload ID: 20384
  Gene Name: zinc finger, SWIM-type containing 8
  ENST ID: ENST00000492395
  CDS Start-End: 1-2715
ataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctgtatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactcta

SEQ ID NO: 204729 - DNA, 5919 bp, Homo sapiens
  Payload ID: 20384
  Gene Name: zinc finger, SWIM-type containing 8
  ENST ID: ENST00000603114
  CDS Start-End: 256-5646
gccgccgagcgcttcgtcccggccctaagtctcggagactggccaagatcaccgcttgcaccgcgctgttgggcgaggcccggtcccgtctctttcccaggcctgagattctcgcccggcacggccgccctgagcgccccggccacccccagccccggctcgcccctcaggccccgggcctcccctcaacccccggccggcggcccaggccccggatccgcggggggggacccggccccggggggtgcgggccccatggagctgatgtttgcagagtgggaggacggagagcgcttctcattcgaggattcggaccgttttgaggaggattcactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacgcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctgtatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggccttgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactct

SEQ ID NO: 204730 - DNA, 3369 bp, Homo sapiens
  Payload ID: 20384
  Gene Name: zinc finger, SWIM-type containing 8
  ENST ID: ENST00000604754
  CDS Start-End: 1-3307
tgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagtggtttctcccacaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaaggtcactgcttctgtcttccagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctgtatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggccttgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacac

SEQ ID NO: 204731 - DNA, 5465 bp, Homo sapiens
  Payload ID: 20384
  Gene Name: zinc finger, SWIM-type containing 8
  ENST ID: ENST00000604524
  CDS Start-End: 224-5191
cggagactggccaagatcaccgcttgcaccgcgctgttgggcgaggcccggtcccgtctctttcccaggcctgagattctcgcccggcacggccgccctgagcgccccggccacccccagccccggctcgcccctcaggccccgggcctcccctcaacccccggccggcggcccaggccccggatccgcggggggggacccggccccggggggtgcgggccccatggagctgatgtttgcagagtgggaggacggagagcgcttctcattcgaggattcggaccgttttgaggaggattcactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaaggtacatccctaccacacagagccagggcttccactgcccaccagtgtggcctgtgagttgtggggccagggaacagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactcta

SEQ ID NO: 204732 - DNA, 630 bp, Homo sapiens
  Payload ID: 20384
  Gene Name: zinc finger, SWIM-type containing 8
  ENST ID: ENST00000466354
  CDS Start-End: 1-613
tgatgatgtcaaatggttgctggggctggcagcaaagctgggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactcta

SEQ ID NO: 204733 - DNA, 6004 bp, Homo sapiens
  Payload ID: 20384
  Gene Name: zinc finger, SWIM-type containing 8
  Uniprot ID: A7E2V4
  ENST ID: ENST00000605216
  CDS Start-End: 218-5731
ctggccaagatcaccgcttgcaccgcgctgttgggcgaggcccggtcccgtctctttcccaggcctgagattctcgcccggcacggccgccctgagcgccccggccacccccagccccggctcgcccctcaggccccgggcctcccctcaacccccggccggcggcccaggccccggatccgcggggggggacccggccccggggggtgcgggccccatggagctgatgtttgcagagtgggaggacggagagcgcttctcattcgaggattcggaccgttttgaggaggattcactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctgtatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactct

SEQ ID NO: 204734 - DNA, 3713 bp, Homo sapiens
  Payload ID: 20384
  Gene Name: zinc finger, SWIM-type containing 8
  ENST ID: ENST00000603187
  CDS Start-End: 1-3697
tgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctgtatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggccttgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactct

SEQ ID NO: 204735 - DNA, 6075 bp, Homo sapiens
  Payload ID: 20384
  Gene Name: zinc finger, SWIM-type containing 8
  ENST ID: ENST00000604729
  CDS Start-End: 298-5802
agctgatgggggaggcggctccgcagccgcctagaggccccagccgccgagcgcttcgtcccggccctaagtctcggagactggccaagatcaccgcttgcaccgcgctgttgggcgaggcccggtcccgtctctttcccaggcctgagattctcgcccggcacggccgccctgagcgccccggccacccccagccccggctcgcccctcaggccccgggcctcccctcaacccccggccggcggcccaggccccggatccgcggggggggacccggccccggggggtgcgggccccatggagctgatgtttgcagagtgggaggacggagagcgcttctcattcgaggattcggaccgttttgaggaggattcactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagtggtttctcccacaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctgtatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggccttgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactct

SEQ ID NO: 204736 - DNA, 4113 bp, Homo sapiens
  Payload ID: 20385
  Gene Name: zinc finger, X-linked, duplicated A
  Uniprot ID: P98168
  ENST ID: ENST00000358697
  CDS Start-End: 401-2800
ctgggaggggctggcgtgtgtttatttgggtatatacaatgagtcacggattaaaattgcttttaccagatagatacctaggtgttccacagcattattgaacaagatgtcgtcatttccccattacttcagaagacctccttaattacttatattaattgtagaatatatttatgcataccaggctctacctctgggctttctattccgttccagagacccagtaccagaatatttaaatcactgtggcgttgaatacattttaatatctgatagggccagtttctgcgcattgcacatttttttttcccctttcaggaacgtgttcaggcccgcggcagggggcgggatcgcgcctcctcctcggctctggttccagccgagcctctcggacgcagagatggaaatcccgaagctgctcccggctcgcgggacactacagggcggcggcggcggcggtatccccgcgggtggcggccgagtccaccgaggccctgactcgccggctggccaggtccccacgcgccgcctcctgctgccccggggcccccaagatggcgggcccgggcggcggcgcgaggaggccagcacggcatcacggggccctggcccaagcctgttcgcgccgaggccccatcaacctagcggcggcggcgacgacttcttcctggtgctgcttgacccggtgggtggcgacgtggagaccgcgggctccggtcaggccgcagggcctgtgttgagggaggaggccaaggcgggcccggggctccagggggacgagagcggcgcgaaccccgcgggctgctctgcgcagggcccccactgcctgtccgcggttcccactccggccccgatctccgcccccggccccgccgcggccttcgcgggcacagtcactatccacaaccaggacctgctgttgcgctttgagaacggcgtcctcaccctggccacgcccccaccacacgcctgggagccaggggccgctcctgcccagcagcccaggtgtctgatcgccccccaagctgggttcccgcaagccgcgcacccgggtgactgcccagagctgcggtccgacctcctgctagccgagcccgcagaacccgcgcctgctccggcgccccaggaggaggcggagggcctggccgccgccctgggcccccgcggactgctgggctctggtccaggcgtggtgctgtacctgtgccccgaggcgctgtgcgggcaaaccttcgccaagaagcaccagctgaagatgcacctgctgacgcacagcagcagccagggccagaggcccttcaaatgccccctgggtggctgcggctggaccttcaccacctcttacaagctcaagaggcacctgcagtcgcacgataaactgcggcccttcggctgccctgcggagggctgtggcaagagcttcaccaccgtgtacaacctcaaggcgcacatgaagggccatgagcaggagaactcgttcaaatgtgaggtgtgcgaggagagcttccccacgcaggccaaactcggcgcccaccagcgcagccacttcgaacccgagaggccttaccagtgcgcgttttctggctgcaagaagacatttatcacagtgagtgctctgttttcccataaccgcgcccatttcagggaacaggaactgttttcctgctctttccctggctgcagcaagcaatatgacaaggcttgtaggctgaaaattcacctgcggagtcacaccggcgagagacctttcctttgtgactttgatggctgtggctggaacttcaccagcatgtccaaactcttaaggcacaaaaggaagcacgacgatgaccggaggttcatgtgccctgtggaaggctgtgggaaatctttcacgagggccgaacatctgaaaggccacagcattacccacctgggcacaaagcctttcgtgtgtcctgtggcaggctgctgtgccaggttctctgctcgcagtagcctctacattcactccaagaaacacctgcaggatgtggacacttggaaaagccgttgcccgatctcctcttgtaataaactcttcacatccaagcacagcatgaagacgcacatggttaaaaggcataaggtgggccaggatctcttagctcagctagaagcagcaaattctcttacacccagcagtgaacttaccagccagagacagaatgatctcagtgatgcagagatagtgtctctcttctctgatgtacctgacagtacttctgctgcattgctggacacagcattggtgaactctggaatcttgactattgatgtggcttctgtgagctcgactctggcagggcacctccctgctaataataataattccgtagggcaggctgtggaccctccgtccttgatggccaccagcgaccctcctcaaagtctggatacctctctcttttttggaacggcggccactggttttcagcagagctccttaaatatggatgaggtctcaagtgtaagtgtggggccattgggatctctggactctttggccatgaaaaactccagtccagagcctcaggctttgacacccagcagtaagctaacagtggacacagatactctgactccttcgagcaccctttgtgaaaacagtgtctcagaactactgacaccagccaaagcggagtggagcgtacatcctaactctgacttctttggacaggagggagaaacccagtttggattccccaatgcagcaggaaaccatggttctcagaaagaaagaaatcttatcactgtgactggcagctcatttttggtatgaagcaactctattcattccttgccatgtggctaacttttattacagtcaattttgaggatattctggactaaatatttaagtgcagtcatttctttttggtttgcaaaaagagcacagccctggactatgagtttggagatctaaattctgatcttgagtctggaactgacaagttgtgtgaccctcagcaagtcacttaacctatctgagccttaatttccttatttataaattgtggtggtttgaacacattgctcataaggtcttttcagttttgttttgttttgttttgtgattttgtgctttttcttgaaaattttcgggcattttgcaattattattgtttgtacttgtaatcagaagcggtttgagccctgtagcactaaataatgaaagattgaggaactggtgttttacattaaaaatttaatggaaattttacacagtacgaaaatctaatgatagagctcaaaaaaaaagagctaaaaataggagttggttcttcttagctgtttatccttctaaccttttttttaaatgatgaaggtatgtttttgttgtggaaaatacaagggcttttgttatcactcagacccagagtgaaatgtttgctttgtggttttgaataagttggcctttaataagttatttagtctctcttagcctcagttttctatctgtaaaatggtcatagcaatgtgaacatatgtgttacatcctagacttatttttctaccccagtaggttgtattgaaaggaaaatgttatatgtgtttcagcatgttttggtgaatcttcattccctttcctgccccttgttttccctcctcaaaggggagaaattagcacaaattagtatcaggattgtgcaggaaataaacatttgtgaaggttaagaaagaggaaaaggaagttatttcttcaacagattaaggatttttctacacacagttcttttgtggcattggccacatgtccattagaccaatttgatagtatcttcggtctgcattcaaagccagctcatgcaatgagtattcagcctattcttccaagacaatctggacatagaccagagggagatttttctcccctctgtgccctagagagctcattgctggcttactcttagagttgaaatgagagggttttgtctgcattttgagtagataccatctatcttatgtgagtatagcattttacaatttagcactttcacaactattatatttgatcctcacaatcctgtgaggtaattatggcaaagtcagatctacaattcatattaaaatttacctagctcagattacaaa

SEQ ID NO: 204737 - DNA, 5894 bp, Homo sapiens
  Payload ID: 20386
  Gene Name: zinc finger, X-linked, duplicated B
  Uniprot ID: P98169
  ENST ID: ENST00000374888
  CDS Start-End: 398-2809
gggctggggtgtgtttatttgggtatatacaatgagtcatggattaaaattgcttccagcggatagatacctaggtgttccacagcattactgaacaagctgtcgtcatttccccattacctcagaagacccccttaattacttacttatattaactgtagaacgtatttatgcataccaggctctacctctgggctttctattctgttccagagacccagtaccagaatatttaaatcactgtggcgttaaatacgttttaatatctgatagggccagtttctgcgcattgcacatttttttttcccctttcaggaacgtgttcaggcccgcggcagggggcgggatcgcgcctcctcctcggctctggttccagccgagcctctcggacgcagagatggaaatcccgaagctgctcccggctcgcgggacactacagggcggcggcggcggcggtatccccgcgggtggcggccgagtccaccgaggccctgactcgccggctggccaggtccccacgcgccgcctcctgctgctccggggcccccaagatggcgggcccgggcggcggcgcgaggaggccagcacggcatcacggggccctggcccaagcctgttggcgccgaggaccgatcaacctagcggcggcggcggcggcggcggcgacgacttcttcctggtgctgcttgacccggtgggtggcgacgtggagaccgcgggctccggtcaggccgcagggcctgtgttgagggaggaggccgaggagggcccggggctccaggggggcgagagcggcgcgaatcccgcggggcccactgcgctaggcccccgctgcctgtccgcggttcccactccggccccgatctccgcccccggccccgccgcggccttcgcgggcacagtcactatccacaaccaggacctgctgttgcgctttgagaacggcgtcctcaccctggccacgcccccaccacacgcctgggagccaggggccgctcctgcccagcagcccgggtgtctgatcgccccgcaagctgggttcccgcatgccgcgcacccgggtgactgcccagagctgccgccagacctcctgctagctgagccggccgaacccgcgccagctccggcgcctgaggaggaggcggagggcccggccgccgccctgggcccccgcggaccgctgggctccggcccaggcgtggtgctgtacttgtgccccgaggcgcagtgcgggcaaaccttcgccaagaagcaccagctgaaggtgcacctgctgacgcacagcagcagccagggccagaggcccttcaaatgccccctgggtggctgcggctggaccttcaccacctcttacaagctcaagaggcacctgcagtcgcacgacaaactgcggccctttggctgcccggcagagggctgtggcaagagcttcaccacagtgtacaacctcaaggcgcacatgaagggccatgagcaggagaactcattcaaatgcgaggtgtgcgaggagagcttccccacgcaggccaaactcagcgcccaccagcgcagccacttcgaaccggagaggccttaccagtgcgcgttttctggctgcaagaagacatttatcacagtgagtgctctgttttcccataaccgcgcccatttcagggaacaggaactgttttcctgctcttttcctggctgcagcaaacaatatgacaaggcttgtaggctgaaaattcacctgcggagtcacaccggcgagagacctttcctttgtgactttgatggctgtggctggaacttcactagcatgtccaaactcttaaggcacaaaagaaagcacgacgatgaccggaggttcatgtgccctgtggaaggctgtgggaaatctttcacgagggcggaacatctgaaaggccacagcataacccacctgggcacaaagcctttcgtgtgtcctgtggcaggctgctgtgccaggttctctgctcgcagtagcctctacattcactccaagaaacacctgcaggatgtggacacttggaaaagccgttgcccgatctcctcttgtaataaactcttcacatccaagcacagcatgaagacgcacatggttaaaaggcataaggtgggccaggatctcttagctcagctagaagcagcaaattctctcacacccagcagtgaacttaccagccagagacagaatgatctcagtgatgcagagatagtgtctctcttctctgatgtacctgacagtacttctgctgcattgctggacacagcattggtgaactctggaatcttgactattgatgtggcttctgtgagctcgactctggcagggcacctccctgctaataataataattccgtagggcaggctgtggaccctccgtccttgatggccaccagcgaccctcctcaaagtctggatacctctctcttttttggaacggcggccactggttttcagcagagctccttaaatatggatgaggtctcaagtgtaagtgtggggccattgggatctctggactctttggccatgaaaaactccagtccagagcctcaggctttgacacccagcagtaagctaacagtggacacagatgctctgactccttcgagcaccctttgtgaaaacagtgtctcagaactactgacaccaaccaaagcggagtggaacgtacatcctgactctgacttctttggacaggagggagaaacccagtttggattccccaatgcagcaggaaaccatggttctcagaaagaaacagatcttatcactgtgactggcagctcatttttggtatgaaccaactctattcattcctcatcatgtggcttacttttattacagtcaattttgaggatattctggactaaatatttaagtgcagtcatttctttttggtttgcaaaaagagcacagccctggactacaagtttggagatttaaattctgatcttgagtttggaactgacaagttgtgtgaccctgagcaagtcagttaacctatctgagccttaatttccttatttataaattgaggtggtttgaatagattgcttttaaggtctttctgctctgtgattccttgataatacatttctttccttgaaaaatatgaggacgtttttcagtgatgtggcatgcgtttttttttaactgcccccccagccctgacatgttctttttttggcaaacatacataatgttacatcatactatgatgaacatccatgtacttttcactcaatttcagcaattatgaatccatgaacaatcttttttaacttagcctcactcactccccatgttctagtattattttgtaacaaatagcagacatctgatcattttatccataaatattctttatatatctctgaaagctatgggatgatatggaaaaaaatgataattccattatcgcaagtgatatttacagtaattctttaatatcagtaaatatccagtgagggttcaaacttccaattgcctcataaatgctacttgttttattatttttaattagtagaatcccgtaaatctcctaagtgtcttcttaatccgtatgtttccctttcatctttctttttttccttgcgattttgtttatgaaatgaggttgtttcacatgtagcatttgccacaatttaagttttgctaattgcatccctatggtaatgtttgctttcctctatcctctgtttctttaatttgctagttatgtctagagacttgatgagattgaaacatggcttttggcatgaatgtttcataggttatgttgtgttcatttagtaggtggcgcataatctgtggttttctctctttttgtggtattagcagctgctgcagataaatgcattaattcatgatgcttctgatatgatgagtcatctttgtagagttactaagcattagcaaaggaggaaatgctatgtaatagaaatattattcaatgccaaaatattttcttaaatagtcatagaactaacaagaaaaaatagatagcaaaaaaatgtgttggctgttctcactgtttatcttcctaacttcttttgatgatggaaggcagttttgtggaaattgccagccaggactttgacatgaaacagacccagggctaaattttggctctgtggtgttggataagtggccttgaataaattagttattaagcttcagttttctagcttttaactgattataacaatgcacacacatacctgacacactgttaaattttcttctcttcctgtttcttatgttaaggaaagatactctgtgttttggcatatgttggtgaatttgtaccatttttatcctctcagtccttccttttataagacaataattggagtagtttaatcttattcatgtgcagataaaagaggtttatgaagtttagggtgaagtaggcaagggaatctgtttactccctcttccctctactgaataattttccctctactgaataattttccctctaagaattgctgtgggtaataccaggagtggggacattgcccacatgcataagagcgtatctctccattcgatcagtttgtcaccatctttgctctgttttgaaagtcaggcttctctgtgactgtgaagcctgctgttccctgaaaatctgataatggagcagtggaggtttttttctttctgtgctctgtagatctcattgtttgcacttgtaatttcccagagttgaaaggaaagattgaactggaatattgtgtaaactatctgtcttacattagtgtagcattttgcaatttggggaacatcttcacaatttgtgtctcgttgttcagaacaaccctgtgaagtagttttggcaatgtctgtgttacatttcatgtaatttagccaactcccattccaactaggctttggctaaatctgacaattttatatatagcttaaaacaaagaatatacattcttttcacccctcccagtctacccatccagccttcatgattcattcctgtgtcaaggttagtcgctgttttccatttgaattggtttcttttatggtcagtttactttcttccctctcccctccctttcctgcacatccccatccttgctatgcctttctgtcctcttttataatggatatatctttttcctgccattatccctcagacattctcctcatggcacattttcttcaaatgctaacatttactgagtgtacattgaagttctgtgcatacaggaagaagttattttctgagcttagataatactatgtgtatatgtgattaaaatgaagattattttctaaagccttcaaattagaagtggatttctgtttcattacttccgttttaaaagtttttgccagagagttttgctaaatactctcttatttgctctagtgtactagtccagtagtgtttgcatgtggatgtctgtggatgacagttattgtagcactttggcagtgcactaaaattttgccactatgaaatgtttctttattgtgtgtgcgtgtgtgttttgaaatacgcacacagccacacccacatatatattaaaagtggttgtattcatttagtgaaaaacaaaaagtagatgtacttctgtaaatcagataaatgcttggaatttgattgtctacccaatcaacagttttccctctttgctctggaaatatttgtactcatatagcatatttcaaaaatgttgtcattcattaaggcctcttaaatagaccactattttttgtgtctggcagatgagtatgtcaaggattgagatgaacacataagtcttggaaattaaataaatttataaacataaagataatttaatgctgtgacttcattttttaaattctttaaaccaactttctcccaataaaaaattataaacta

SEQ ID NO: 204738 - DNA, 2468 bp, Homo sapiens
  Payload ID: 20387
  Gene Name: zinc finger, ZZ-type containing 3
  Uniprot ID: Q8IYH5
  ENST ID: ENST00000370798
  CDS Start-End: 487-1716
aggagcgggaggcggggacccacctggaagcgccgcggcgccgctatcgagcttcctgcagcggtggccacccgagcaagtgccgtggcgggggcggagagcggccacggcggcggcgcctccccaagtggcccgttgcgtccgaccccgcgtgaaagatatcaagttattctagtacaaccatataaataaataatacctgaagtctcagtgtaacatggacaattaacagtgatgacagataaatacagacgcatggggatcaaatactaggcaaaacgctttttaaaagtgtatcaggcttttaagaaacactgcaggatcctgtctatcttaatgctgatagagctcagctaaaaatttaggaggttctagtattcttcatggctgaagctgagagagtctgaaaccctgatgcttaagctccattctagatcatagctccaactccttcaggatataaggaaaagagattatatttccacaatgatagatctttggttgtacagttatcagagactattacagacgattgctgtactcgaggctcagcgttctcaagcagtccaagaccttgaaagtttaggcaggcaccagagagaagcactgaaaaatcccattggatttgtggaaaaactccagaagaaggctgatattgggcttccatatccacagagagttgttcaattgcctgagatcgtatgggaccaatatacccatagccttgggaattttgaaagagaatttaaaaatcgtaaaagacatactagaagagttaagctagtttttgataaagtaggtttacctgctagaccaaaaagtcctttagatcctaagaaggatggagagtccctttcatattctatgttgcctttgagtgatggtccagaaggctcaagcagtcgtcctcagatgataagaggacgcttgtgtgatgataccaaacctgaaacatttaaccagttgtggactgttgaagaacagaaaaagctggaacagctactcatcaaataccctcctgaagaagtagaatctcgacgctggcagaagatagcagatgaattgggcaacaggacagcaaaacaggttgccagccgagtacagaagtatttcataaagctaactaaagctggcattccagtaccaggcagaacaccaaacttatatatatactccaaaaagtcttcaacaagcagacgacagcaccctcttaataagcatctctttaagccttccactttcatgacttcacatgaaccgccagtgtatatggatgaagatgatgaccgatcttgttttcatagccacatgaacactgctgttgaagatgcatcagatgacgaaagtattcctatcatgtataggaatttacctgaatataaagaactattacagtttaaaaagttaaagaagcagaaacttcagcaaatgcaagctgaaagtggatttgtgcaacatgtgggctttaagtgtgataactgtggcatagaacccatccagggtgttcggtggcattgccaggattgtcctccagaaatgtctttggatttctgtgattcttgttcagactgtctacatgaaacagatattcacaaggaagatcaccaattagaacctatttataggtcagagacattcttagacagagactactgtgtgtctcagggcaccagttacaattaccttgacccaaactactttccagcaaacagatgacatggaagagaacatcatttactagtcctcttcaacacatagcaatggtatcattgttaattatgtgcacagtttggaaagattctctgctttcccagaaatgacactcacagcatgagagcttcctgagtgttctcgtcaagtacagctctgcaccgttgtggctctagatcactgttcagcagctgaacattcctggtgagcaaaggtttccctggtgaatttttcaccactgcgttttaggtggtgatcttaaatgggtgagatggaacgagagcacacattaaagagagagtaaattccaaaggtttcaaagaacttggtcataaatatgataatgagaagacaaagtatttatattaaaacagtttagtagccttcagttttgtgaaaatagttttcagcacagaaactgacttctttagacaaagttttaaccaatgatggtgtttgcttctaggatatacactttaaaagaactcactgtcccagtggtggtcattgatggcctttagtaaattggagctgcttaatcatattgatatctaatttcttttaaccacaatgaattgtccttaattaccaacagtgaagcactacaggaggcaactgtggcattgcttccttaaccagctcatggtgtgtgaatgttataaaattgtcactcagatatattttttaaatgtaatgttatataagatgatcatgtgatgtgtacaaactatggtgaaaagtgccagtggtagtaactg

SEQ ID NO: 204739 - DNA, 4328 bp, Homo sapiens
  Payload ID: 20387
  Gene Name: zinc finger, ZZ-type containing 3
  Uniprot ID: Q8IYH5
  ENST ID: ENST00000370801
  CDS Start-End: 477-3188
gttggcagagcagttgtcctggatggcggagccttgggttccgggggcctgggacctgcaactctttctacaagatatcaagttattctagtacaaccatataaataaataatacctgaagtctcagtgtaacatggacaattaacagtgatgacagataaatacagacgcatggggatcaaatactaggcaaaacgctttttaaaagtgtatcaggcttttaagaaacactgcaggatcctgtctatcttaatgctgatagagctcagctaaaaatttaggaggttctagtattcttcatggctgaagctgagagagtctgaaaccctgatgcttaagctccattctagatcatagctccaactccttcaggatataaggaaaagagattatatttccacaatgatagatctttggttgtacaggtttcccaatgagtggatcatgatgaccgtattgtagggacttgccatagtatggctgcttcccgatctactcgtgttacaagatcaacagtggggttaaacggcttggatgaatctttttgtggtagaactttaaggaatcgtagcattgcgcatcctgaagaaatctcttctaattctcaagtacgatcaagatcaccaaagaagagaccagagcctgtgccaattcagaaaggaaataataatgggagaaccactgatttaaaacagcagagtacccgagaatcatgggtaagccctaggaaaagaggactttcttcttcagaaaaggataacatagaaaggcaggctatagaaaattgtgagagaaggcaaacagaacctgtttcaccagttttaaaaagaattaagcgttgtcttagatctgaagcaccaaacagttcagaagaagattctcctataaaatcagacaaggagtcagtagaacagaggagtacagtagtggacaatgatgcagattttcaagggactaaacgagcttgtcgatgtcttatactggatgattgtgagaaaagggaaattaaaaaggtgaatgtcagtgaggaagggccacttaattctgcagtagttgaagaaatcacaggctatttggctgtcaatggtgttgatgacagtgattcagctgttataaactgtgatgactgtcagcctgatgggaacactaaacaaaatagcattggttcctatgtgttacaggaaaaatcagtagctgaaaatggggatacggatacccaaacttcaatgttccttgatagtaggaaggaggacagttatatagaccataaggtgccttgcacagattcacaagtgcaggtcaagttggaggaccacaaaatagtaactgcctgcttgcctgtggaacatgttaatcagctgactactgagccagctacagggcccttttctgaaactcagtcatctttaagggattctgaggaggaagtagatgtggtgggagatagcagtgcctcaaaagagcagtgtaaagaaaacaccaataacgaactggacacaagtcttgagagtatgccagcctccggagaacctgaaccatctcctgttctagactgtgtttcagctcaaatgatgtctttatcagaacctcaagaacatcgttatactctgagaacctcaccacgaagggcagcccctaccagaggtagtcccactaaaaacagttctccttacagagaaaatggacaatttgaggagaataatcttagtcctaatgaaacaaatgcaactgttagtgataatgtaagtcaatctcctacaaatcctggtgaaatttctcaaaatgaaaaagggatatgttgtgactctcaaaataatggaagtgaaggagtaagtaaaccaccctcagaggcaagactcaatattggacatttgccatctgccaaagagagtgccagtcagcacattacagaagaggaagatgatgatcctgatgtttattactttgaatcagatcatgtggcactgaaacacaacaaagattatcagagactattacagacgattgctgtactcgaggctcagcgttctcaagcagtccaagaccttgaaagtttaggcaggcaccagagagaagcactgaaaaatcccattggatttgtggaaaaactccagaagaaggctgatattgggcttccatatccacagagagttgttcaattgcctgagatcgtatgggaccaatatacccatagccttgggaattttgaaagagaatttaaaaatcgtaaaagacatactagaagagttaagctagtttttgataaagtaggtttacctgctagaccaaaaagtcctttagatcctaagaaggatggagagtccctttcatattctatgttgcctttgagtgatggtccagaaggctcaagcagtcgtcctcagatgataagaggacgcttgtgtgatgataccaaacctgaaacatttaaccagttgtggactgttgaagaacagaaaaagctggaacagctactcatcaaataccctcctgaagaagtagaatctcgacgctggcagaagatagcagatgaattgggcaacaggacagcaaaacaggttgccagccgagtacagaagtatttcataaagctaactaaagctggcattccagtaccaggcagaacaccaaacttatatatatactccaaaaagtcttcaacaagcagacgacagcaccctcttaataagcatctctttaagccttccactttcatgacttcacatgaaccgccagtgtatatggatgaagatgatgaccgatcttgttttcatagccacatgaacactgctgttgaagatgcatcagatgacgaaagtattcctatcatgtataggaatttacctgaatataaagaactattacagtttaaaaagttaaagaagcagaaacttcagcaaatgcaagctgaaagtggatttgtgcaacatgtgggctttaagtgtgataactgtggcatagaacccatccagggtgttcggtggcattgccaggattgtcctccagaaatgtctttggatttctgtgattcttgttcagactgtctacatgaaacagatattcacaaggaagatcaccaattagaacctatttataggtcagagacattcttagacagagactactgtgtgtctcagggcaccagttacaattaccttgacccaaactactttccagcaaacagatgacatggaagagaacatcatttactagtcctcttcaacacatagcaatggtatcattgttaattatgtgcacagtttggaaagattctctgctttcccagaaatgacactcacagcatgagagcttcctgagtgttctcgtcaagtacagctctgcaccgttgtggctctagatcactgttcagcagctgaacattcctggtgagcaaaggtttccctggtgaatttttcaccactgcgttttaggtggtgatcttaaatgggtgagatggaacgagagcacacattaaagagagagtaaattccaaaggtttcaaagaacttggtcataaatatgataatgagaagacaaagtatttatattaaaacagtttagtagccttcagttttgtgaaaatagttttcagcacagaaactgacttctttagacaaagttttaaccaatgatggtgtttgcttctaggatatacactttaaaagaactcactgtcccagtggtggtcattgatggcctttagtaaattggagctgcttaatcatattgatatctaatttcttttaaccacaatgaattgtccttaattaccaacagtgaagcactacaggaggcaactgtggcattgcttccttaaccagctcatggtgtgtgaatgttataaaattgtcactcagatatattttttaaatgtaatgttatataagatgatcatgtgatgtgtacaaactatggtgaaaagtgccagtggtagtaactgtgtaaagtttctaattcacaacattaattcctttaaaatacacagccttctgcctctgtatttggagttgtcagtacaactcatcaaagaaaactgcctaatataaaaatcatatatatggtaataatttccctcttttgtagtctgcacaagatccataaaagattgtatttttattactatttaaacaagtgattaaatttagtctgcacagtgagcaagggttcacatgcattcttttatactgctggattttgttgtgcatcatttaaaacattttgtatgtttcttcttatctgtgtatacagtatgttcttgaatgatgttcatttgtcaggagaactgtgagaaataaactatgtggatactgtctgtttatattatagaa

SEQ ID NO: 204740 - DNA, 561 bp, Homo sapiens
  Payload ID: 20387
  Gene Name: zinc finger, ZZ-type containing 3
  ENST ID: ENST00000414381
  CDS Start-End: 453-561
atcgagcttcctgcagcggtggccacccgagcaagtgccgtggcgggggcggagagcggccacggcggcggcgcctccccaagtggcccgttgcgtccgaccccgcgtgaaagatatcaagttattctagtacaaccatataaataaataatacctgaagtctcagtgtaacatggacaattaacagtgatgacagataaatacagacgcatggggatcaaatactaggcaaaacgctttttaaaagaaaaatttaggaggttctagtattcttcatggctgaagctgagagagtctgaaaccctgatgcttaagctccattctagatcatagctccaactccttcaggatataaggaaaagagattatatttccacaatgatagatctttggttgtacaggtttcccaatgagtggatcatgatgaccgtattgtagggacttgccatagtatggctgcttcccgatctactcgtgttacaagatcaacagtggggttaaacggcttggatgaatctttttgtggtagaactttaaggaatcgtagcattgcgcatcctg

SEQ ID NO: 204741 - DNA, 603 bp, Homo sapiens
  Payload ID: 20387
  Gene Name: zinc finger, ZZ-type containing 3
  ENST ID: ENST00000433749
  CDS Start-End: 431-603
gattctcgcgggacctcgttggcagagcagttgtcctggatggcggagccttgggttccgggggcctgggacctgcaactctttctacaagatatcaagttattctagtacaaccatataaataaataatacctgaagtctcagtgtaacatggacaattaacagtgatgacagataaatacagacgcatggggatcaaatactaggcaaaacgctttttaaaagaaaaatttaggaggttctagtattcttcatggctgaagctgagagagtctgaaaccctgatgcttaagctccattctagatcatagctccaactccttcaggatataaggaaaagagattatatttccacaatgatagatctttggttgtacaggtttcccaatgagtggatcatgatgaccgtattgtagggacttgccatagtatggctgcttcccgatctactcgtgttacaagatcaacagtggggttaaacggcttggatgaatctttttgtggtagaactttaaggaatcgtagcattgcgcatcctgaagaaatctcttctaattctcaagtacgatcaagatcaccaaagaagagaccagagcctgtgcc

SEQ ID NO: 204742 - DNA, 11456 bp, Homo sapiens
  Payload ID: 20388
  Gene Name: zinc finger, ZZ-type with EF-hand domain 1
  Uniprot ID: O43149
  ENST ID: ENST00000381638
  CDS Start-End: 126-9011
aagccgcaggggccgccgtcgtctcctccgcgtccccgcccgccagctgctgtcggaggttgacaggtcgaggcggggaggcggcggcggcggctgcagagccaggcgcccaagacggagaccccatggggaacgctccgagtcacagcagtgaagacgaagcggcagctgccggtggcgagggctggggcccacaccaggactgggccgcggtctcgggcacgacccccggcccgggcgtcgcggctccagcgctaccacccgccgcggcgctgctggagccggccaggctgcgagaggctgctgcagcgttgctgcccacacccccctgcgagtcgctggtgtcgaggcatcgcggcgcgttgtttcgctggctggaagagcggctgggccgcggcgaagagtctgtcactctggagcagttccgggagctgctggaggctcgcggcgccggctgctctagcgagcagttcgaggaggcctttgcccagtttgatgctgagggtgatgggacagttgatgccgagaacatgttggaggccctcaagaattccagtggagctaatcttcagggggagctgagccacatcatcagacaactacaggcctgctctctggttccaggtttcacagacatattttcagagtcgaaggagggccttgatattcactcgtcaatgatactgcgcttcctgcaccgcaatcggctctccagcgcggtgatgccctacccgatgctggagcactgcaataacatgtgcaccatgcggtcttccgtcctgaaggagtctctggatcagctggtacaaaaggaaaaggaaagccctggagatctaactagaagtccagagatggataaactcaagtcagtagcaaagtgctatgcttatatagaaacatcctccaactcggcagacattgacaagatgacaaatggagaaacctcatcctactggcagtcagatggcagtgcctgttcacactggattcgtttaaaaatgaagccagatgttgtgcttaggcacctgtccattgcagtggctgccactgaccagagctacatgccacagcaggtgacagtagctgtagggaggaatgccagcgatcttcaggaagtccgagatgtgcacatccccagcaatgtcactggctatgtgacgctgctggaaaatgccaacgtcagtcagctctatgtccagattaacataaagcgttgtcttagcgatggctgcgacactagaattcatggtctcagggctgttggctttcagagagttaagaagtctggggtctcagtctcagatgcttctgcaatatggtattggtctctgctgacatctctggtgacggcttctatggagacaaatcccgcctttgtccagacagtgctgcacaatactcagaaggcgctgcggcacatgcctccactctctctctcaccaggatctacagatttctcaactttcctctcccctaatgtgctggaagaagtggacagtttcctcataaggataactagctgctgttctaccccagaggtagaactgactcttctggcttttgctctcgcaagaggaagtgttgccaaagtcatgagctctctatgcaccatcactgaccatctggacacgcagtatgatgcctcatccctcatcttgtccatggcgtcagtcagacagaacctgctcctcaaatatggtaaacctctccagttgactcttcaggcatgtgatgtcaaaggaaaagaagataagtctggacccgaaaacctccttgttgaaccgtggacaagggatggttttcttacggaaactggaaaaaccagagccagcactattttttctaccggaactgaatctgccttccaagttacacagataagaattatggttcgacgtggtggcattggtgcccagtgtgggttggtgtttgcctataactcatcttcagataaattttgtgcggaagaacacttcaaaaggtttgaaaaatatgacaaatggaagcttcaggagctcaggcaatttgtaaaaagcaggattggttgctcatctgatgaccttggagaggatgatcctattggctggtttgaactggaagaagaatgggatgaagcagatgtgaagctgcaacagtgcagagttgccaaatatttgatggtgaagttcctctgcacccgtcaggagtcagcagagcgcttgggagtgcaaggcttgaccatcagtgggtacctccggcctgcaagagcagaagcagaacagagcgtcacctgtgcacactgcagaaaggacacagaggagagtgtctgtggggccacgttgctcctcaggacccttcagtttatccagcagctcgcccatgacctggtgcagcagaaggaaagtggcttaaaatataaatcttttctggacttcgcgggtcttgatttgcagatcttctggaatttttacagtaaattaaagcaaaacccgagggaagaatgcgtctctgcccaaaccctgcttctgcagctactccagagctgcttctctgtgctgcagggagatgtactggctgcttctgaggaggaaaaggctccaatccaaagccctaaaggagtagaggctgccaaggagctgtacacacacttgtgtgatgtggtggacaaggtggatggagactctgtgcccatggagatactaaaacaagaagtcaggaatacccttctcaatggggctgccatcttctttcctaatcgacagacccgacggaaccatctcttcaccatgatgaatgtcaccgagcaggagcacaagcagtccctgcagctcactttccgttcactgtgcacgtattttagtgacaaggatccaggcggccttcttcttttacctgagaagaacgacctggccaagatgaacatcagtgaagtcctggcggtcatggacactctcgtctctgttgctgctcgagagtgcgagctgttaatgctcagtggggccccaggggaggtgggctctgtgctcttctccctgttctggtccgtccaaggcagcctgctatcctggtgctacctgcagctgaagagcacggactctggagccaaagatcttgccgtggaccttattgaaaaatatgtgggccagtttctggcaagcatgagagcgattttggaatcccttttctcacagtacagtggaaaaaccatagtagaaagattatgtaactcagtgttttcaatggcagctcgtcaactggttatcttcctgctggacttctgcactttagacatcccacactgcgtgctcttgagagagttcagcgtcctcacagaactcctgaagaagctctgtagtggccccgaaggaggactgaggaagctggatgttgagacctggcaacaggaacagcctgtggtgttacatacgtggacgaaggaatctgcccacaactatgaaaataattgccatgaggtatccgtctttgttagcccaggggcaacctattttgaagtggaattcgatgacaggtgtgaaactgaaaaaaggtatgattatctggaatttaccgacgctagaggtcggaaaacacgctatgacacaaaagttggcactgataaatggcccaagaaagtgaccttcaaggccggtcctcggttgcagttcctctttcactctgacagcagtcacaacgaatggggctacaaattcactgtcactgcctgtgggctgcccgatgttgccgtgtcttgggggctggatttacagctcctcgtctcccggctgatgggacgcctggcttcccagtgcatggcgctcaagtctgtgcgccagttaggaagtaacatggtagtacctcaggcaaaaatggcattagtcctaagctccccactgtggaaacctgtcttcaggcatcaggtttgtccagagttggaattagaagcaagctggcccactcacccacaccggaatagtaaggaggttaagaacattcctgacgacccctgccgccattttcttcttgattttgcccagtcagagcctgctcagaacttctgtgggccatattcagaacttttcaaaggattcatacaggcatgtagaaaacaggccccaaagacagatatagttgctggttccactattgatcaagctgtgaacgccacctttgctgctctggtgtatcgcactccagatttatatgagaagctgcaaaaatatgtcaacagtgggggcaaaatagccctgagtgaagagtttgcccaggtttattccttggcagatgggattcgaatatggatgttagagatgaagcagaagtccctgatgagcctggggaatgaagcagaagaaaaacatagttcagaagctactgaggtgaaccctgagagcctggcaaaagagtgcattgagaagagtcttctattactaaaatttctgcccacgggcataagttcaaaagaaagctgcgaaaagttggagactgctgatgaaaccagtcatctccagccactcaacaagcgtcagaggacaagctctgtggtggaagagcatttccaagcctcagtatctcccactgaagccgcaccccctgccacaggagaccagagtcctggcctgggcacccagccaaagctgccatccagcagtggccttcctgctgcagacgtgtcccctgccacagctgaagagcccttgtcaccttccacacccacccgccggcctcccttcacccgagggcgactccggctgctctcctttcgatccatggaggaggccagactggtgcccacagtgaaagagaaataccctgtgctgaaggacgtcatggacttcattaaggatcagtcgctctcgcacaggagtgttgtgaaggttctttccctgaggaaagcccaggcccagagcatcctggaagtcctgaagataactcagcactgtgcagaatcccttgggcagccccactgcttccatccacctttcatacttttcctgttggaacttctgacctgtcagaaagattttaccaattattttggacacctggaaggctgtggtgctgatctacacaaagaaattcgagacacttactatcaacttgttctgtttttggtcaaagcagttaaaggatttagtagcctaaatgacaggtccttgctccctgccttatcctgtgttcagacagccctgcttcatcttttggatatgggctgggaacccaatgatctcgccttctttgttgatattcagttaccagatctcctcatgaaaatgtcacaggagaatataagtgtccatgacagtgtgatcagccaatggagtgaagaagatgagcttgctgatgccaagcagaattcagaatggatggatgagtgtcaggatggcatgtttgaggcctggtatgaaaaaatagcccaggaagatccagagaagcagaggaaaatgcacatgttcattgctcgctactgtgacctgttaaatgtggacatctcttgtgatgggtgtgatgagattgccccctggcatcgataccgctgtctgcagtgcagcgacatggatctctgcaaaacttgcttcctaggtggggtgaagcctgagggccacggagacgaccatgaaatggtcaacatggagtttacctgtgaccactgccagggtttgatcataggccggaggatgaactgcaatgtttgcgatgactttgatctttgctacggatgctatgcagcgaagaaatactcctacggccatttgcctacccacagcatcacggcccacccaatggtaaccattcggatcagtgaccggcagaggctcatccagccatatatccataactactcctggctgctctttgctgccctggctctctatagcgcccacctggccagtgcagaggatgtggatggggagaagctggacccccagacgcgcagcagtgccaccaccctgcggagccagtgcatgcagctcgtcggggactgtctgatgaaggctcatcagggaaaaggccttaaagctctagctttgctgggtgtattgccagatggggactcgagcctagaagatcaggccctaccagtcactgtgcccaccggagcgtcagaggagcagctagagaagaaagctgtccagggtgctgagctgtcagaagcaggcaatggaaagagagctgttcatgaggaaatcagacctgtagatttcaagcagagaaataaggcagataaaggtgtatcattatcgaaggatccttcatgccagacccaaatttcagattcacctgcagatgctagcccacctacaggacttccagatgctgaagattcagaagtgtcatctcagaagcccatagaggaaaaagcagttactccaagccctgagcaagtgtttgctgagtgttcccagaagaggattttgggattactagcagccatgttacctcccttaaagtcgggccccacggttcccctgatagacctggagcacgtccttccactcatgtttcaggttgtcatctcaaacgcaggccacctgaatgaaacctaccatctcaccctgggtcttctcggccagttaattatccgtcttttgccagcagaggtagacgccgcagtgatcaaagtcctctcagccaaacacaacctgtttgctgcaggggacagttccattgtgccagatggctggaaaaccacccacctgctctttagcctgggagctgtgtgtctggacagccgggtgggcttggactgggcgtgctccatggcagagatcctgcggtcactcaacagtgccccactgtggcgtgatgtcattgccaccttcacagaccactgcatcaagcagctgccattccagctgaagcacaccaacatcttcaccctgctcgtgctggttggcttcccccaggtcctctgtgtgggaacccgctgcgtttatatggataatgccaatgaaccccataatgtgatcatcttgaagcactttactgagaagaacagggctgtgattgttgatgtcaaaactcggaagaggaaaacagtgaaggactaccagctggtccagaagggaggaggacaagagtgtggtgactctcgggcccagctgagccagtactcccagcactttgcctttatcgccagtcaccttctgcaaagcagcatggacagccattgtcccgaggcagtagaagcaacttgggtcctgtccctggccctgaaaggattgtataaaacactaaaggctcacggttttgaggagatccgtgctactttccttcagaccgatttgctgaagttgctggtgaaaaagtgcagcaaagggactggctttagtaaaacgtggctcctccgggacctggaaattttgtccatcatgctgtactcctcaaaaaaggagatcaacgctttggctgagcacggagacctagagctggatgagcgaggggaccgagaggaagaggtggaacggccagtcagcagccctggcgacccagagcagaaaaagctggacccccttgagggcctggatgagcccaccagaatatgtttcttgatggctcatgatgccctcaatgcccctctgcacattctccgggccatatacgaactgcagatgaaaaagaccgattatttcttcctggaggttcagaagaggtttgatggtgatgagctcaccacagatgaaaggatacggtccctggctcagcggtggcagcccagtaagagtctgaggctggaagaacagagcgccaaagctgtggatacagacatgattatcctgccatgcttgtcccggcctgcacgctgtgaccaagccactgctgaatcgaaccctgtgacccagaagctgatctccagcacagagagcgaactgcagcagagctatgccaagcagcgccgtagcaagagcgccgccctcctgcacaaggagctgaactgcaagagtaagagggctgtccgggactacctcttccgagtgaacgaggccacagctgtcctgtacgcccgccacgtgcttgcatccctgctcgccgagtggcctagccacgtgccagtgagcgaggacatcctggagctcagtggccctgcccatatgacctacattttggatatgttcatgcagctggaagaaaagcatgagtgggagaagatcctgcagaaagtgctccagggctgccgagaggacatgctggggaccatggccctggctgcatgccagttcatggaggagccaggaatggaggtgcaagtgagggagtcgaaacacccgtataacaacaacaccaacttcgaggataaagttcacattcctggtgccatctacctctcaatcaaattcgactctcagtgcaacacagaggagggctgtgacgagttagccatgtccagcagcagtgacttccagcaagaccgacacagcttcagcgggtctcagcagaagtggaaagattttgaacttccaggagacactctgtattaccgcttcacctccgacatgagcaacaccgagtggggctacagattcaccgtgacggccggacacctggggcggttccagacaggattcgagattttgaagcagatgttgtcagaagaaagggtcgtgcctcatctcccattggcaaaaatttgggaatggctggtgggcgtggcctgtcgccagactggccatcaacgattaaaagccatccacttacttctgaggattgtgcgatgctgcggccacagtgacctgtgtgaccttgcgctgttgaagcccctgtggcagctctttacccacatggagtacggcctgtttgaggacgtgacgcagcccggcatcctccttcccctgcatcgtgccctcactgagctcttcttcgtcaccgagaaccgtgcccaggagcttggcgtgctgcaggattacctgctggccctaaccacggacgaccaccttctccgctgtgcggcacaggctctgcagaacattgctgccatcagcctggccatcaactacccaaacaaggccacccgcctctggaatgtggagtgttagcccttggtggggcgtgcatgggactagttcatctgccacagggattttagagcagacatctaacctcattcaggaaaactcctgtagcgccagtgcccagctctccttgagctgaccactccagttaggatgccaagcagccacgtctccaagagctcccgtgcgtaggctggacacaagcacaggctgtagcatggtgaaaataagccaagcagtgcagaatgcctcagaaagggtgggcagggggcccttaagaaggttcagagaccagccttctccagaggctgtcactgcaggagccgtgggcctgggaagacttggaagcggcctctctcaactggtttctgtctccgtggagctggaactgcctgcacttgccttcagagggaggcacagtccacccagatccacctttccagcaagacccccagtggctgcccagcctgggagcacctctttgcttttcacaccaaaccaaaactggcgagagcccctcctagccaccagtgatccccaagcatccagtacagaaccaggcatcgagctagctccctgcacggccgcaccctcccagagaactccttgaggagaacaagtgcccttggggacagccggcaggcgcccctgtacgtctgctcatgcaccaggcagcacagccgcagttcctcagttgttgttttgacatatttcagtttccacctcacgtttttagagcagaaccacactgtctccctggaggggctcgagggcatgaccggggactgaccattctgtgaaaggagcagaatgtgaggagcacgcgtgagcttatgtaccgtgaagatgatcagaggatatcttattttaagagtaaaaacccacataattttatttctgcttgatagtcatggtagtctgtcatacccacctctgggactctgcgtggctgtttggctgtcacttgtagcaataacgacattagttctagtcagtgctgttttacatttttcttttgatgggtttagtcttgccctggagtgccgatgatgattctccctccagagccacgcttgggaacatgaagcaagtctggcgtgtgggctgcgtgccggccttagtgggacccgtggggttggagcatgcctttaggggcagtgtctgggccgaagcacgtcccaccacacagtgccagagccagagaaggggccccaccaccaaggccaagcttgaccaggtcagcattgccatggcccagtgtgccccgtggcctctgaagatccctctgtgcagggtctgcagggatctggattgcaagggcccaagtctgcaggtctggaagcatcttcctataagagcactttcgccttctgggtcaggactccaaggtgcagcgggcttcacagccctacaattgggttctcagctaagccccagagttctggtagaaccatcccggggcgggtggagggtgggatttaagggagacgggaacacatggggcaggtcctggaacttggtggcctgaggactgaggccattgccctggtggaaaggcctggcctggttcctgtggcttgggacctgaataggcaggtgctgctggctccgtagaaacccttttcccatcttttgctctttgccaaacctaccttgctttgggagctgcctgcaccaccccagagaaggccccaccttcttcatccctcagacccgaggaggcctcccagtaaggagtttcccaagaggggactcacaggaaacaagtcttagtgcttgggagggaggccccgctgcgtgctcagactcacagccaacctggaaggtagacgagatagcgccacccacgcccctccacaccccagactccgagtaaagcgggcggtagggccggagtcacctcccctatggcagtggccgccgctgtactccatcctcccgtcaggaagatcagctgtaaataaacgctgggctccccagagcacctgtccgcccactgcccttgctgttctgggatcttcgctgcagttcacgggaaacaagcctgagtccgctcgcacccgcggctgctctcccggctcggcccggccgcctctgtctccggccaccgggtggcgctgccgagccagagccgccgcgtcccggcgctttccaggagccccaggcccggaggaggcgaagcccgcagagcaaaggtggaaacacgtgcctacgctgtaaagaaatcctgttccagagcatacctgttgtacaaacagacactgttcctaacgagaggagtgacgtattttcatcaccgtttttaatttgttttcttacgggtttacgattttgaatttttcttatttggttgaaagaattttgattctatcagcctgagtgagttcagcctgtaaaaaggatgttaagctgtgggtaaaatatgcaaacgaaaagaaatatattgtacaaattctatataataaggta

SEQ ID NO: 204743 - DNA, 2667 bp, Homo sapiens
  Payload ID: 20388
  Gene Name: zinc finger, ZZ-type with EF-hand domain 1
  ENST ID: ENST00000573183
  CDS Start-End: 1-2438
tacttttcctgttggaacttctgacctgtcagaaagattttaccaattattttggacacctggaaggctgtggtgctgatctacacaaagaaattcgagacacttactatcaacttgttctgtttttggtcaaagcagttaaaggatttagtagcctaaatgacaggtccttgctccctgccttatcctgtgttcagacagccctgcttcatcttttggatatgggctgggaacccaatgatctcgccttctttgttgatattcagttaccagatctcctcatgaaaatgtcacaggagaatataagtgtccatgacagtgtgatcagccaatggagtgaagaagatgagcttgctgatgccaagcagaattcagaatggatggatgagtgtcaggatggcatgtttgaggcctggtatgaaaaaatagcccaggaagatccagagaagcagaggaaaatgcacatgttcattgctcgctactgtgacctgttaaatgtggacatctcttgtgatgggtgtgatgagattgccccctggcatcgataccgctgtctgcagtgcagcgacatggatctctgcaaaacttgcttcctaggtggggtgaagcctgagggccacggagacgaccatgaaatggtcaacatggagtttacctgtgaccactgccagggtttgatcataggccggaggatgaactgcaatgtttgcgatgactttgatctttgctacggatgctatgcagcgaagaaatactcctacggccatttgcctacccacagcatcacggcccacccaatggtaaccattcggatcagtgaccggcagaggctcatccagccatatatccataactactcctggctgctctttgctgccctggctctctatagcgcccacctggccagtgcagaggatgtggatggggagaagctggacccccagacgcgcagcagtgccaccaccctgcggagccagtgcatgcagctcgtcggggactgtctgatgaaggctcatcagggaaaaggccttaaagctctagctttgctgggtgtattgccagatggggactcgagcctagaagatcaggccctaccagtcactgtgcccaccggagcgtcagaggagcagctagagaagaaagctgtccagggtgctgagctgtcagaagcaggcaatggaaagagagctgttcatgaggaaatcagacctgtagatttcaagcagagaaataaggcagataaaggtgtatcattatcgaaggatccttcatgccagacccaaatttcagattcacctgcagatgctagcccacctacaggacttccagatgctgaagattcagaagtgtcatctcagaagcccatagaggaaaaagcagttactccaagccctgagcaagtgtttgctgagtgttcccagaagaggattttgggattactagcagccatgttacctcccttaaagtcgggccccacggttcccctgatagacctggagcacgtccttccactcatgtttcaggttgtcatctcaaacgcaggccacctgaatgaaacctaccatctcaccctgggtcttctcggccagttaattatccgtcttttgccagcagaggtagacgccgcagtgatcaaagtcctctcagccaaacacaacctgtttgctgcaggggacagttccattgtgccagatggctggaaaaccacccacctgctctttagcctgggagctgtgtgtctggacagccgggtgggcttggactgggcgtgctccatggcagagatcctgcggtcactcaacagtgccccactgtggcgtgatgtcattgccaccttcacagaccactgcatcaagcagctgccattccagctgaagcacaccaacatcttcaccctgctcgtgctggttggcttcccccaggtcctctgtgtgggaacccgctgcgtttatatggataatgccaatgaaccccataatgtgatcatcttgaagcactttactgagaagaacagggctgtgattgttgatgtcaaaactcggaagaggaaaacagtgaaggactaccagctggtccagaagggaggaggacaagagtgtggtgactctcgggcccagctgagccagtactcccagcactttgcctttatcgccagtcaccttctgcaaagcagcatggacagccattgtcccgaggcagtagaagcaacttgggtcctgtccctggccctgaaaggattgtataaaacactaaaggctcacggttttgaggagatccgtgctactttccttcagaccgatttgctgaagttgctggtgaaaaagtgcagcaaagggactggctttagtaaaacgtggctcctccgggacctggaagtaagagacgagagggactcctgctcctctttcctggtgcagatgtgctggcctaggagttagaagcatcaccgagttccagctgcttctgccctgtgcacactcctttagtacagtgttgaaaactcccttgcttctgtattccctgttggaaatagggattatgacacctgtctacccctgtcagggaaaatgaatttaatgtttgttcaaagaacagtggaagagaagcattttatggaaacacatgattaaccattatatcatggtaataaagtatacccttgaattc

SEQ ID NO: 204744 - DNA, 2831 bp, Homo sapiens
  Payload ID: 20388
  Gene Name: zinc finger, ZZ-type with EF-hand domain 1
  ENST ID: ENST00000571436
  CDS Start-End: 1-658
gcccttgtcaccttccacacccacccgccggcctcccttcacccgagggcgactccggctgctctcctttcgatccatggaggaggccagactggtgcccacagtgaaagagaaataccctgtgctgaaggacgtcatggacttcattaaggatcagtcgctctcgcacaggagtgttgtgaaggttctttccctgaggaaagcccaggcccagagcatcctggaagtcctgaagataactcagcactgtgcagaatcccttgggcagccccactgcttccatccacctttcatacttttcctgttggaacttctgacctgtcagaaagattttaccaattattttggacacctggaaggctgtggtgctgatctacacaaagaaattcgagacacttactatcaacttgttctgtttttggtcaaagcagttaaaggatttagtagcctaaatgacaggtccttgctccctgccttatcctgtgttcagacagccctgcttcatcttttggatatgggctgggaacccaatgatctcgccttctttgttgatattcagttaccagatctcctcatgaaaatgtcacaggagaatataagtgtccatgacagtgtgatcagatgcacatgttcattgctcgctactgtgacctgttaaatgtggacatctcttgtgatgggtgtgatgagattgccccctggcatcgataccgctgtctgcagtgcagcgacatggatctctgcaaaacttgcttcctaggtggggtgaagcctgagggccacggagacgaccatgaaatggtcaacatggagtttacctgtgaccactgccagggtttgatcataggccggaggatgaactgcaatgtttgcgatgactttgatctttgctacggatgctatgcagcgaagaaatactcctacggccatttgcctacccacagcatcacggcccacccaatggtaaccattcggatcagtgaccggcagaggctcatccagccatatatccataactactcctggctgctctttgctgccctggctctctatagcgcccacctggccagtgcagaggatgtggatggggagaagctggacccccagacgcgcagcagtgccaccaccctgcggagccagtgcatgcagctcgtcggggactgtctgatgaaggctcatcagggaaaaggccttaaagctctagctttgctgggtgtattgccagatggggactcgagcctagaagatcaggccctaccagtcactgtgcccaccggagcgtcagaggagcagctagagaagaaagctgtccagggtgctgagctgtcagaagcaggcaatggaaagagagctgttcatgaggaaatcagacctgtagatttcaagcagagaaataaggcagataaaggtgtatcattatcgaaggatccttcatgccagacccaaatttcagattcacctgcagatgctagcccacctacaggacttccagatgctgaagattcagaagtgtcatctcagaagcccatagaggaaaaagcagttactccaagccctgagcaagtgtttgctgagtgttcccagaagaggattttgggattactagcagccatgttacctcccttaaagtcgggccccacggttcccctgatagacctggagcacgtccttccactcatgtttcaggttgtcatctcaaacgcaggccacctgaatgaaacctaccatctcaccctgggtcttctcggccagttaattatccgtcttttgccagcagaggtagacgccgcagtgatcaaagtcctctcagccaaacacaacctgtttgctgcaggggacagttccattgtgccagatggctggaaaaccacccacctgctctttagcctgggagctgtgtgtctggacagccgggtgggcttggactgggcgtgctccatggcagagatcctgcggtcactcaacagtgccccactgtggcgtgatgtcattgccaccttcacagaccactgcatcaagcagctgccattccagctgaagcacaccaacatcttcaccctgctcgtgctggttggcttcccccaggtcctctgtgtgggaacccgctgcgtttatatggataatgccaatgaaccccataatgtgatcatcttgaagcactttactgagaagaacagggctgtgattgttgatgtcaaaactcggaagaggaaaacagtgaaggactaccagctggtccagaagggaggaggacaagagtgtggtgactctcgggcccagctgagccagtactcccagcactttgcctttatcgccagtcaccttctgcaaagcagcatggacagccattgtcccgaggcagtagaagcaacttgggtcctgtccctggccctgaaaggattgtataaaacactaaaggctcacggttttgaggagatccgtgctactttccttcagaccgatttgctgaagttgctggtgaaaaagtgcagcaaagggactggctttagtaaaacgtggctcctccgggacctggaagtaagagacgagagggactcctgctcctctttcctggtgcagatgtgctggcctaggagttagaagcatcaccgagttccagctgcttctgccctgtgcacactcctttagtacagtgttgaaaactcccttgcttctgtattccctgttggaaatagggattatgacacctgtctacccctgtcagggaaaatgaatttaatgtttgttcaaagaacagtggaagagaagcattttatggaaacacatgattaaccattatatcatggtaataaagtatacccttgaattca

SEQ ID NO: 204745 - DNA, 558 bp, Homo sapiens
  Payload ID: 20388
  Gene Name: zinc finger, ZZ-type with EF-hand domain 1
  ENST ID: ENST00000572831
  CDS Start-End: 1-200
ttgcatccctgctcgccgagtggcctagccacgtgccagtgagcgaggacatcctggagctcagtggccctgcccatatgacctacattttggatatgttcatgcagctggaagaaaagcatgagtgggagaaggccaatccacctgcttggctggggactccttcaaggaccaggaccctttatgattggttcagttagttctttcagaccacctctaagtagcatcattctgaaaggactgcagtgtcctgattgacaccaagagcctggtcaaatcctgcagaaagtgctccagggctgccgagaggacatgctggggaccatggccctggctgcatgccagttcatggaggagccaggaatggaggtgcaagtgagggagtcgaaacacccgtataacaacaacaccaacttcgaggataaagttcacattcctggtgccatctacctctcaatcaaattcgactctcagtgcaacacagaggagggctgtgacgagttagccatgtccagcagcagtgacttccagcaagaccgacacagcttcagcgggtct

SEQ ID NO: 204746 - DNA, 689 bp, Homo sapiens
  Payload ID: 20388
  Gene Name: zinc finger, ZZ-type with EF-hand domain 1
  ENST ID: ENST00000572699
  CDS Start-End: 1-447
aggtatgattatctggaatttaccgacgctagaggtcggaaaacacgctatgacacaaaagttggcactgataaatggcccaagaaagtgaccttcaaggccggtcctcggttgcagttcctctttcactctgacagcagtcacaacgaatggggctacaaattcactgtcactgcctgtgggctgcccgatgttgccgtgtcttgggggctggatttacagctcctcgtctcccggctgatgggacgcctggcttcccagtgcatggcgctcaagtctgtgcgccagttaggaagtaacatggtagtacctcaggcaaaaatggcattagtcctaagctccccactgtggaaacctgtcttcaggcatcaggtttgtccagagttggaattagaagcaagctggcccactcacccacaccggaatagtaaggagggtgaagtctaactcctcaatgtgacagtcaaggctctctgcagtctcctttcaccttacctatctgactctagttcccatcactccccagctgagacttcaggccaggttaagaacattcctgacgacccctgccgccattttcttcttgattttgcccagtcagagcctgctcagaacttctgtgggccatattcagaacttttcaaaggattcatacaggcatgtagaaaacaggccccaaagacagatat

SEQ ID NO: 204747 - DNA, 5200 bp, Homo sapiens
  Payload ID: 20389
  Gene Name: zinc fingers and homeoboxes 1
  Uniprot ID: Q9UKY1
  ENST ID: ENST00000297857
  CDS Start-End: 706-3327
gacgcgcgcgcgggagggccccgccttggccggctctctcccttccccctccgcccccggacggccgctggggcgcgcgcctctcctcgcacccccaccctgagtccccacactccgcggggccaccgagctgctgaggcccctttgcgggcccgccgagcggttccgggtttagggttcacaggtcagagttgactccctgaaaagtgcagccggtttgaaatgcaagatggcggcggcgtggcgctgagaggcgcggcggcccctgcaggtagtggcgcgagccggctccgcgaccagcgggcccggagactctgggctgcgggtgggaactggagcgcagagtccgcggccggcacgggaaaggagaagacagactgctgctttggacctgttggtaatgatggcctgagctaaacatctaactagaagggatacccttccatttcaaagaacagaatgctaaggaagctgtggcaagtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacaggtgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcagaaacaaagccagcaacagcagcagttccaacttctcaaagtgtcaaacatgaaactgcattggtaaaccctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggtaaaaaaaaaaaaaaaaaaaaaaccctgatttattactatgtcttatttatcagaccctgcactaagattaaaagttgtgcatgggcttatacaatttcaaatgtaaaaacagcctatttatatatgttgaaacaataagattttatggtttcactggcccttaataattggatccttcattaaacacatccatgaataccactgtttctactgttacttgttccattagaagctgatttgctttttattaaactgcaggaaattaattctgaagaaggaaaagaaactgacatggtaatttggatagggtgaagctttgaaataaatactgcaccaaaaatgtgaaaaagaatcacgtagtaaatgtatacttagtgttttcttacaatcgtggaaatcagaaatgtttatacaggtgtcagatcagaatttttaagagttatctttcagtgaaattttataacagtttcagtgaatagagaaaaaattctgaactgatcataatgagttaaaagttagcttttcacttatgaatcatgggagtgttaactgttaactcttgccgtatcaggagactgaaagttcatactaatttacaaactttgtaaagactggtgctgttcattcatattgggaagaaccctttcttttgtgaccataggaccatttttcaaaatgcgctttcttcgtagaagaaatgttcagtttaattagctttggattttaacatgtttttctgaatgaccagatgtaggcttagccagtttattttctctaatttaatggataataaatattaagctcttggttaaatgtttttcagccattgaaaatgttatgaaaaagccttgaatatgcatgctgctttcatttttataaactttttattttttaactatagctttattagtaattccaaaatgctgcaatgtagctgatttcctcactcagacagctggctttgtgggtggcttttttcatactactgttaacttttttaaaaaagaagcaatgtaaagaccgtaatgcactaagctttttttttttcttttacacgtttaaaaacttcttaaagcactctgtaatataatgattaaattgctcccttttataaacattgctaatgtggtctgagttttgtttgacaataattttaatgttctcaaaatttgaaatgtcaagtattagaaatgaagcctttgaatatagttgtttcccttgcaatatgttaactctgtgtagctgtatataactattaatttccctcatctcttttataggcctgataaaactcttctctgacgtttgctagcttttaaatatatttatttgacagagcaaaagaaccctcttctggttgattgtgaccttgaatacaaaataaaagtagtgattagtagtttacagtg

SEQ ID NO: 204748 - DNA, 5108 bp, Homo sapiens
  Payload ID: 20389
  Gene Name: zinc fingers and homeoboxes 1
  Uniprot ID: Q9UKY1
  ENST ID: ENST00000395571
  CDS Start-End: 619-3240
gcgcggaggacgcgcgcgcgggagggccccgccttggccggctctctcccttccccctccgcccccggacggccgctggggcgcgcgcctctcctcgcacccccaccctgagtccccacactccgcggggccaccgagctgctgaggcccctttgcgggcccgccgagcggttccgggtttagggttcacaggtcagagttgactccctgaaaagtgcagccggtttgaaatgcaagatggcggcggcgtggcgctgagaggcgcggcggcccctgcaggagaagacagactgctgctttggacctgttggtaatgatggcctgagctaaacatctaactagaagggatacccttccatttcaaagaacagaatgctaaggaagctgtggcaagtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacaggtgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcagaaacaaagccagcaacagcagcagttccaacttctcaaagtgtcaaacatgaaactgcattggtaaaccctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggtaaaaaaaaaaaaaaaaaaaaaaccctgatttattactatgtcttatttatcagaccctgcactaagattaaaagttgtgcatgggcttatacaatttcaaatgtaaaaacagcctatttatatatgttgaaacaataagattttatggtttcactggcccttaataattggatccttcattaaacacatccatgaataccactgtttctactgttacttgttccattagaagctgatttgctttttattaaactgcaggaaattaattctgaagaaggaaaagaaactgacatggtaatttggatagggtgaagctttgaaataaatactgcaccaaaaatgtgaaaaagaatcacgtagtaaatgtatacttagtgttttcttacaatcgtggaaatcagaaatgtttatacaggtgtcagatcagaatttttaagagttatctttcagtgaaattttataacagtttcagtgaatagagaaaaaattctgaactgatcataatgagttaaaagttagcttttcacttatgaatcatgggagtgttaactgttaactcttgccgtatcaggagactgaaagttcatactaatttacaaactttgtaaagactggtgctgttcattcatattgggaagaaccctttcttttgtgaccataggaccatttttcaaaatgcgctttcttcgtagaagaaatgttcagtttaattagctttggattttaacatgtttttctgaatgaccagatgtaggcttagccagtttattttctctaatttaatggataataaatattaagctcttggttaaatgtttttcagccattgaaaatgttatgaaaaagccttgaatatgcatgctgctttcatttttataaactttttattttttaactatagctttattagtaattccaaaatgctgcaatgtagctgatttcctcactcagacagctggctttgtgggtggcttttttcatactactgttaacttttttaaaaaagaagcaatgtaaagaccgtaatgcactaagctttttttttttcttttacacgtttaaaaacttcttaaagcactctgtaatataatgattaaattgctcccttttataaacattgctaatgtggtctgagttttgtttgacaataattttaatgttctcaaaatttgaaatgtcaagtattagaaatgaagcctttgaatatagttgtttcccttgcaatatgttaactctgtgtagctgtatataactattaatttccctcatctcttttataggcctgataaaactcttctctgacgtttgctagcttttaaatatatttatttgacagagcaaaagaaccctcttctggttgattgtgaccttgaatacaaaataaaagtagtgattagtagttta

SEQ ID NO: 204749 - DNA, 3357 bp, Homo sapiens
  Payload ID: 20389
  Gene Name: zinc fingers and homeoboxes 1
  Uniprot ID: Q9UKY1
  ENST ID: ENST00000522655
  CDS Start-End: 542-3163
aaaaaatcagacttccacttgaagcaattgcatcttttaggattaatgtggctcagcggagctctgctgtgcttttaggattactgtggctcagcggagctctgcacaaagggtccgcgactgggatgggggtggggagtgaacgtcaaggggcccaggagcgctcgagcgtccaaggcccggcgtgtggagcagctggagggagaagacagactgctgctttggacctgttggtaatgatggcctgagctaaacatctaactagaagggatacccttccatttcaaagaacagaatgctaaggaagctgtggcaagtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacaggtgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcagaaacaaagccagcaacagcagcagttccaacttctcaaagtgtcaaacatgaaactgcattggtaaaccctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgc

SEQ ID NO: 204750 - DNA, 1014 bp, Homo sapiens
  Payload ID: 20389
  Gene Name: zinc fingers and homeoboxes 1
  ENST ID: ENST00000602651
  CDS Start-End: 1-118
tgaggaggaagatgaagttattgatgaccaggaagaggatgaagaagaaacagatgatagtgacacttgggaacctccacgacatgtgaaacggaagctgtctaaatcagatgactgaaatgtaagttaagaaaatttttaatctgcgtatatgttcatcaaccacatacattttgaacagtcaccttgttgtatcagtcatcttcatttttgatattttctgaagtagtttttcttttccctaataagactaggtaccactagtatagctaagagataaatgattatcatgtgtagttttattattattatgtagagtttaatgtcttaattattatttttcatatgaattgggttttttttactttgttttgaaggaaagttacccaatctctatgaagggagactggcaggcaggttgaggggattcacaaacaaatactaaagataactaaaatgtattttattgcaatgcccccttcactaaagcttcattttttgcctatttaaggaaataattcaaaaatgaaaactaaaaagaaggggaaaagtacaccaaaggaaagacttaccacagggttgaggattgtgcagttttaggaaactaggtgaaaatgggtatcttttcatcttcattgcattgctcccaaaactttactagacttttaactagagtttaaaatgctttatgtatttatgaaattactcagtatctttttagtaatttataaaattactcaatatctttttctgttaaaagtcaaaggtctgttttaggccatatataaattcatgtttgcttaggcggcatctgtctttgaaaactgtgatataaattatttctgttttagagatcaaaaggcaaataacagatttgatataaacccaattgcttaaaatatcttttcattctttggtataaaacaaacctgctaccagcactaacattgtatttgatttaaagtatatctctgtagtcttaaaaatgcaaataaatatggcttaaatttgaaa

SEQ ID NO: 204751 - DNA, 4624 bp, Homo sapiens
  Payload ID: 20390
  Gene Name: zinc fingers and homeoboxes 2
  Uniprot ID: Q9Y6X8
  ENST ID: ENST00000314393
  CDS Start-End: 836-3349
ccccctcctcttctcgcagaaattccaccgagtccgttactgggctcagacttttaagttaatttactgcccccctaccttggccagtaaccagcgcctttagggctagcctcccccccagctcctgcctgaaaaatgacatttcgccggtgtctccggagggggctgaatttcactttgtaactttctgcggaacccgagcccgggtggcagctcgggtggtggtatcgtatgcaaatacgcatgctgacgttacagatcatgtgggttttggcgtagattccccactgatcgaggcattttttttccctttttttttcctttttttttttcttttaaaaattttggccatcgttctccgtacgggggctttttctgtctgtctgtctggctggcaggctggctttccccctctttcccacggagcccgagccgggcgcccggtggggagtggggagtgggtggggggagccagcagagttccattttggaacgcccgtgccgcgtctccgcgttcccagcccgggtccccgcgttcacagccccagcgcaggtctggatgtaccgactgcttttggaataaaaagattcccaggatgtgagcaacacgggaccgatatgatgcttcctggtgtgtttagtggttggtgccattccaattttctgtgctgaaatcattctgaaaactcaaacagtagacttcagcacacaaggaaagccaaagccatttgagggggaataaagccaaaagcctttcaccttattcgttccaagaatctcaccgccccctccttatccccctccaaaaataagccattgcacacagacaggcagcatggctagcaaacgaaaatctacaactccatgcatggttcggacatcacaagtagtagaacaagatgtgcccgaggaagtagacagggccaaagagaaaggaatcggcacaccacagcctgacgtggccaaggacagttgggcagcagaacttgaaaactcttccaaagaaaacgaagtgatagaggtgaaatctatgggggaaagccagtccaaaaaactccaaggtggttatgagtgcaaatactgcccctactccacgcaaaacctgaacgagttcacggagcatgtcgacatgcagcatcccaacgtgattctcaaccccctctacgtgtgtgcagaatgtaacttcacaaccaaaaagtacgactccctatccgaccacaactccaagttccatcccggggaggccaacttcaagctgaagttaattaaacgcaataatcaaactgtcttggaacagtccatcgaaaccaccaaccatgtcgtgtccatcaccaccagtggccctggaactggtgacagtgattctgggatctcggtgagtaaaacccccatcatgaagcctggaaaaccaaaagcggatgccaagaaggtgcccaagaagcccgaggagatcacccccgagaaccacgtggaagggaccgcccgcctggtgacagacacagctgagatcctctcgagactcggcggggtggagctcctccaagacacattaggacacgtcatgccttctgtacagctgccaccaaatatcaaccttgtgcccaaggtccctgtcccactaaatactaccaaatacaactctgccctggatacaaatgccacgatgatcaactctttcaacaagtttccttacccgacccaggctgagttgtcctggctgacagctgcctccaaacacccagaggagcacatcagaatctggtttgccacccagcgcttaaagcatggcatcagctggtccccagaagaggtggaggaggcccggaagaagatgttcaacggcaccatccagtcagtacccccgaccatcactgtgctgcccgcccagttggcccccacaaaggtgacgcagcccatcctccagacggctctaccgtgccagatcctcggccagactagcctggtgctgactcaggtgaccagcgggtcaacaaccgtctcttgctcccccatcacacttgccgtggcaggagtcaccaaccatggccagaagagacccttggtgactccccaagctgcccccgaacccaagcgtccacacatcgctcaggtgccagagcccccacccaaggtggccaaccccccgctcacaccagccagtgaccgcaagaagacaaaggagcagatagcacatctcaaggccagctttctccagagccagttccctgacgatgccgaggtttaccggctcatcgaggtgactggccttgccaggagcgagatcaagaagtggttcagtgaccaccgatatcggtgtcaaaggggcatcgtccacatcaccagcgaatcccttgccaaagaccagttggccatcgcggcctcccgacacggtcgcacgtatcatgcgtacccagactttgccccccagaagttcaaagagaaaacacagggtcaggttaaaatcttggaagacagctttttgaaaagttcttttcctacccaagcagaactggatcggctaagggtggagaccaagctgagcaggagagagatcgactcctggttctcggagaggcggaagcttcgagacagcatggaacaagctgtcttggattccatggggtctggcaaaaaaggccaagatgtgggagcccccaatggtgctctgtctcgactcgaccagctctccggtgcccagttaacaagttctctgcccagcccttcgccagcaattgcaaaaagtcaagaacaggttcatctcctgaggagcacgtttgcaagaacccagtggcctactccccaggagtacgaccagttagcggccaagactggcctggtccgaactgagattgtgcgttggttcaaggagaacagatgcttgctgaaaacgggaaccgtgaagtggatggagcagtaccagcaccagcccatggcagatgatcacggctacgatgccgtagcaaggaaagcaacaaaacccatggccgagagcccaaagaacgggggtgatgtggttccacaatattacaaggaccccaaaaagctctgcgaagaggacttggagaagttggtgaccagggtaaaagtaggcagcgagccagcaaaagactgtttgccagcaaagccctcagaggccacctcagaccggtcagagggcagcagccgggacggccagggtagcgacgagaacgaggagtcgagcgttgtggattacgtggaggtgacggtcggggaggaggatgcgatctcagatagatcagatagctggagtcaggctgcggcagaaggtgtgtcggaactggctgaatcagactccgactgcgtccctgcagaggctggccaggcctagacagggaagtctgttagaactgctgtgctgatcaacgggacgctccgtctttgaagaaagaagagatggtctctccccagccatgggccacccttgccagtgactccaagtggaactacttagctcgcgtgtgcctggagggtgcgggaagtccagcgactctcagacgcacctcccagaggaccggtgggaattgttcatagtgccaaagtcctactactgcgttttcaatgggtccttgtacatagtttgctcctctgccctagccctcacctcttgctatactggaaccgatttgtacaatgtgggaattttgttacctttttaatcaagggcaacttccttttccagcactaccattgtaaggtttttttcaggagggagggctaaccaccttgcttttctcttttctctttttcttttttttatttttgttttattaatttggggaaaggggtgttagcattagtgccatgatatctactggattttaagtagggagactttatttttaaaggtaggttgaaatttgggagatttctcggcaggaagggctgaaatccaggcccctgtctcaacttggagagaggtgacagacggcagatcttccaaatcaaattcctttccagttcttcccctggctgcctttttgggggtccctgccttagccccacacaaggctttctgaactgccaagaggggatctggcttctcaactgctcggcctcttgggccaggctgtgcccagccagccctgggagaactgggtagcaggtggctgacttctttaagcacctttctaaataccagcagaagaggctcccgcctctgttagcatgatcagtactattgtgacattaaaacaacaacaataagatcttcctatctggagggtacagaggtgaatggctttggttttcatttctcttcttcactgccttttctcggtgtggtatttgacaagattttagctcaaagcctcaccatgaattgattttttttgtttgtgtgtgtgtttgttttgggacaattttagatacctgagtgcactttttcagttagtcctaacttttaaaagaaggaaaaccaagagacatatctggtgtacgtgttgcagtatgaactctggttgcaatccctccccgtcccacactgccccccatttgagtacaccgcacaagtcaaacgctaggaagtttgaataaaaccaatttttctaacttgttgctcatttgttgtaactcaataaagcaaagactaaacatttttataacc

SEQ ID NO: 204752 - DNA, 873 bp, Homo sapiens
  Payload ID: 20390
  Gene Name: zinc fingers and homeoboxes 2
  ENST ID: ENST00000534247
  CDS Start-End: 375-873
cccagtcccccattgactccatcctgctagaaaagagatggacacccaattgctctgccctgcttttgatactgagtttctgtcccctgtaggtctggatgtaccgactgcttttggaataaaaagattcccaggatgtgagcaacacgggaccgatatgatgcttcctggtgtgtttagtggttggtgccattccaattttctgtgctgaaatcattctgaaaactcaaacagtagacttcagcacacaaggaaagccaaagccatttgagggggaataaagccaaaagcctttcaccttattcgttccaagaatctcaccgccccctccttatccccctccaaaaataagccattgcacacagacaggcagcatggctagcaaacgaaaatctacaactccatgcatggttcggacatcacaagtagtagaacaagatgtgcccgaggaagtagacagggccaaagagaaaggaatcggcacaccacagcctgacgtggccaaggacagttgggcagcagaacttgaaaactcttccaaagaaaacgaagtgatagaggtgaaatctatgggggaaagccagtccaaaaaactccaaggtggttatgagtgcaaatactgcccctactccacgcaaaacctgaacgagttcacggagcatgtcgacatgcagcatcccaacgtgattctcaaccccctctacgtgtgtgcagaatgtaacttcacaaccaaaaagtacgactccctatccgaccacaactccaagttccatcccggggaggccaacttcaagctgaagttaattaaacgcaataatcaaactgtcttggaacagtccatcgaaaccaccaaccatgtcgtgtccatcacca

SEQ ID NO: 204753 - DNA, 10030 bp, Homo sapiens
  Payload ID: 20391
  Gene Name: zinc fingers and homeoboxes 3
  Uniprot ID: Q9H4I2
  ENST ID: ENST00000309060
  CDS Start-End: 417-3287
aaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaagtaaggaaaaaatgaggaaactgagacacagcttaagaattttgcccaaagctacaaagattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacaatgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgctctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagcttttttattttgggaggggaggagtgtcatttttgagaatcttgggttcctgaaaaagaacgccctagttggatggcttgccagggccttggggtttggtagtgattgtacaacttaaagctcctttctcttggctgagtgacaggtggctgttcaggtggaccaaagcaccttgacacaaggactccacactgtgctctctagtagcacaaggaggaagttggacagaacattgggtagtgccttgcgggctcacacatgtactagtggtctcatctccagctagccttgggaggccgtcccaccaggaaatctctctattccgtagcctgagatgtgcccttgtgggttttatcctgctcagtcagtggcctaggggcaggtcctgtgttctctccctctctctcctggctctgggacatctgtccctggctgcctttcatggaggaaggacactggcctttctggttggatgctgtgtggatgctctctgcttgagcctcgtggtctcttgtctctttttggaccaatatcctcagattggtgcagctttttcagttcagatatcacaccccaagtggataaaggcaacttgcaggagaggagagccagccaagaagaaaattttaaaaccaaacctcgtttaggattttcctaaagtcatcttctcttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatatttcaca

SEQ ID NO: 204754 - DNA, 657 bp, Homo sapiens
  Payload ID: 20391
  Gene Name: zinc fingers and homeoboxes 3
  ENST ID: ENST00000373261
  CDS Start-End: 369-657
aaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaagtaaggaaaaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatga

SEQ ID NO: 204755 - DNA, 688 bp, Homo sapiens
  Payload ID: 20391
  Gene Name: zinc fingers and homeoboxes 3
  ENST ID: ENST00000441102
  CDS Start-End: 334-688
gccggccgcccgcccggccgcggggagggaggcccgcagcgcgggaagagcggcccggtcgcgggcgccgccaccgccgccgctgccaggactgaaatgcaactgcagaagcaacatgtgaccttttagagatgcttgtgggactgcataaagtgaagagggaaactggaaaaaaacaatgaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaa

SEQ ID NO: 204756 - DNA, 573 bp, Homo sapiens
  Payload ID: 20391
  Gene Name: zinc fingers and homeoboxes 3
  ENST ID: ENST00000419740
  CDS Start-End: 435-573
ttctttccagctctggacaggaaaacatgaaaacagatgatcccaaggaggtttctccctaaactaacaattaaagaatatagttttactttttcatttttatttgttgaaactgaatccacaccaggaaaacccgaatggaagaacatcagaaaatagcacatccttgaagttacaaagcaacacatctgactgaaatgcaactgcagaagcaacatgtgaccttttagagatgcttgtgggactgcataaagtgaagagggaaactggaaaaaaacaatgaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctg

SEQ ID NO: 204757 - DNA, 712 bp, Homo sapiens
  Payload ID: 20391
  Gene Name: zinc fingers and homeoboxes 3
  ENST ID: ENST00000436099
  CDS Start-End: 570-712
agactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaatcccttccataggaaacagggaatgtttgtttctgtcttctggtaggagaaggattggtcccacccccagctccagggatggatcttgattgtttaagcccagtcagtgattctaacccatggaccaagaccctgccttggagattggggaacaggtgttggaagggctctattttggcaaagaatggattatttatgtgagcatatttccgcaaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgc

SEQ ID NO: 204758 - DNA, 792 bp, Homo sapiens
  Payload ID: 20391
  Gene Name: zinc fingers and homeoboxes 3
  ENST ID: ENST00000436440
  CDS Start-End: 524-792
aaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaagctaatcccgaactcctggcctcaaatgatcttcctaccttggcttcccaaagtgctgggattacagacgtgagctgctgtgcctggccaagacttaattttgaatgacattgggactattgccaaaaatcaaatccatcttcatgttgtccacttctcagccttaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgac

SEQ ID NO: 204759 - DNA, 8838 bp, Homo sapiens
  Payload ID: 20391
  Gene Name: zinc fingers and homeoboxes 3
  ENST ID: ENST00000421422
  CDS Start-End: 1-2035
ggccaaggcccttcccaaagtgatgatccccctgagcagcattccaacgtacaatgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcggttcctggtcactgagttcccagcctctcccttccctccttaccctttgacatttgtgttctcattagagaccccatcagagggcagccagaagctcagaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgctctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagcttttttattttgggaggggaggagtgtcatttttgagaatcttgggttcctgaaaaagaacgccctagttggatggcttgccagggccttggggtttggtagtgattgtacaacttaaagctcctttctcttggctgagtgacaggtggctgttcaggtggaccaaagcaccttgacacaaggactccacactgtgctctctagtagcacaaggaggaagttggacagaacattgggtagtgccttgcgggctcacacatgtactagtggtctcatctccagctagccttgggaggccgtcccaccaggaaatctctctattccgtagcctgagatgtgcccttgtgggttttatcctgctcagtcagtggcctaggggcaggtcctgtgttctctccctctctctcctggctctgggacatctgtccctggctgcctttcatggaggaaggacactggcctttctggttggatgctgtgtggatgctctctgcttgagcctcgtggtctcttgtctctttttggaccaatatcctcagattggtgcagctttttcagttcagatatcacaccccaagtggataaaggcaacttgcaggagaggagagccagccaagaagaaaattttaaaaccaaacctcgtttaggattttcctaaagtcatcttctcttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatatttcaca

SEQ ID NO: 204760 - DNA, 3551 bp, Homo sapiens
  Payload ID: 20391
  Gene Name: zinc fingers and homeoboxes 3
  Uniprot ID: Q9H4I2
  ENST ID: ENST00000432768
  CDS Start-End: 406-3276
agcactaacattcttgtgtgctgaattgtgatagccgtcaaaggcagcaaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacaatgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcag

SEQ ID NO: 204761 - DNA, 3933 bp, Homo sapiens
  Payload ID: 20391
  Gene Name: zinc fingers and homeoboxes 3
  Uniprot ID: Q9H4I2
  ENST ID: ENST00000544979
  CDS Start-End: 466-3375
ggaagttctttccagctctggacaggaaaacatgaaaacagatgatcccaaggaggactgaaatgcaactgcagaagcaacatgtgaccttttagagatgcttgtgggactgcataaagtgaagagggaaactggaaaaaaacaatgaagctaatcccgaactcctggcctcaaatgatcttcctaccttggcttcccaaagtgctgggattacagacgtgagctgctgtgcctggccaagacttaattttgaatgacattgggactattgccaaaaatcaaatccatcttcatgttgtccacttctcagccttaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacaatgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcagaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaa

SEQ ID NO: 204762 - DNA, 6296 bp, Homo sapiens
  Payload ID: 20391
  Gene Name: zinc fingers and homeoboxes 3
  Uniprot ID: Q9H4I2
  ENST ID: ENST00000559234
  CDS Start-End: 350-3220
cctgcgccggccgcccgcccggccgcggggagggaggcccgcagcgcgggaagagcggcccggtcgcgggcgccgccaccgccgccgctgccaggactgaaatgcaactgcagaagcaacatgtgaccttttagagatgcttgtgggactgcataaagtgaagagggaaactggaaaaaaacaatgaagtaaggaaaaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacaatgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgctctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttg

SEQ ID NO: 204763 - DNA, 490 bp, Homo sapiens
  Payload ID: 20391
  Gene Name: zinc fingers and homeoboxes 3
  ENST ID: ENST00000559436
  CDS Start-End: 1-384
gtcattgcccctggcaaccgggagctcctgcaggactattacatgacacacaagatgctgtatgaagaggacctgcagaacctctgtgacaagacccagatgagctcccagcagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcat

SEQ ID NO: 204764 - DNA, 4283 bp, Homo sapiens
  Payload ID: 20391
  Gene Name: zinc fingers and homeoboxes 3
  ENST ID: ENST00000560364
  CDS Start-End: 524-1471
aaaggcagcaaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaaatgaggaaactgagacacagcttaagaattttgcccaaagctacaaagtgattctaacccatggaccaagaccctgccttggagattggggaacaggtgttggaagggctctattttggcaaagaatggattatttatgtgagcatatttccgcaaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggagaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgctctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttga

SEQ ID NO: 204765 - DNA, 4140 bp, Homo sapiens
  Payload ID: 20391
  Gene Name: zinc fingers and homeoboxes 3
  Uniprot ID: Q9H4I2
  ENST ID: ENST00000560361
  CDS Start-End: 906-3776
agccgtcaaaggcagcaaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaacatttatcaccatccagccactgtagataaatttgattggctgtctccctgccttcccttcacacccagtaccttccctgcctgaaatcctcattgagggcaagaactttatccccaggatctaaaccagtgctggacaatagatgctcatcccttccataggaaacagggaatgtttgtttctgtcttctggtaggagaaggattggtcccacccccagctccagggatggatcttgattgtttaagcccagtcagtgattctaacccatggaccaagaccctgccttggagattggggaacaggtgttggaagggctctattttggcaaagaatggattatttatgtgagcatatttccgcaaagctaatcccgaactcctggcctcaaatgatcttcctaccttggcttcccaaagtgctgggattacagacgtgagctgctgtgcctggccaagacttaattttgaatgacattgggactattgccaaaaatcaaatccatcttcatgttgtccacttctcagccttaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacaatgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaaca

SEQ ID NO: 204766 - DNA, 1528 bp, Homo sapiens
  Payload ID: 20391
  Gene Name: zinc fingers and homeoboxes 3
  ENST ID: ENST00000558993
  CDS Start-End: 476-1423
cgtagaaggcgcaaaagggggtggtagaggggaagcgggggcgttcgcgcaggcccgcctgaccgtgtgagagtgcatgcccgagtgtgcgttccgcgtgtgcacccgagagccgcctgcgtccacgcccgagggcccttgcactctgctgggatgtggcagcccatgcccccggtgtaaagagcgtcagctcgaccagtgaaggcggcagagccaggactcgaaccactcggggtacagtagcaccctgaatcttgggacccttgtctgcccacgcgaaaacactacacgtgggccccaggtcctcggattccctgagtggcgtattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggagaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtca

SEQ ID NO: 204767 - DNA, 3108 bp, Homo sapiens
  Payload ID: 20392
  Gene Name: zinc metallopeptidase STE24
  Uniprot ID: O75844
  ENST ID: ENST00000372759
  CDS Start-End: 166-1593
ctgtgacactgccagcagcgcgcagagggagggatgggggcgggtatcggcgtaggggccctcggaaagaacggatattgctgtgacaccgcggggacgctctgaagggacgagtgtcggtgtggcaccggtgcacgctgaaggagccggcggaaccgggtggccatggggatgtgggcatcgctggacgctttgtgggagatgccggccgagaagcgtatcttcggggccgtgctgctcttttcctggacagtgtatctttgggagaccttcctagcacagcggcagagaaggatatataaaacaacaactcatgtaccaccggagttaggacagatcatggattctgaaacatttgagaaatctcgactctatcaactggataaaagcactttcagcttctggtcaggactctattcagagactgaaggcactcttattcttctctttggaggaataccttatctctggagactttctggacggttctgtggttatgctggctttggaccagaatatgagatcactcagtccctggtgtttctgctgttggctacacttttcagtgcattgactggtttgccatggagtctttataatacttttgtgatagaagaaaaacatggcttcaatcaacagactttggggttcttcatgaaagatgcaatcaagaaatttgttgtgactcagtgtattttgttgcctgtgtcttcacttctactttacattattaaaattgggggtgactatttttttatttatgcctggctgttcacattagttgtgtctctggttcttgtcacaatctatgctgattatattgcccctttatttgacaaattcacacctctgcctgagggaaagcttaaagaagaaattgaagtaatggcaaagagtattgactttcctttgacgaaggtgtatgttgtggaaggatctaaacgctcttcccacagcaatgcttatttttatggcttcttcaagaacaagcgaatagttttgtttgacactctactagaagagtactctgtactaaacaaagacatccaggaggattctggcatggaaccccgcaatgaggaagaagggaacagtgaagaaataaaagctaaagttaaaaataagaaacaaggatgtaaaaatgaggaggtactcgctgtactaggccatgaactggggcactggaagttgggacatacagtcaaaaatatcattattagccagatgaattctttcctgtgtttttttttatttgctgtattaattggtcgaaaggagctttttgctgcatttggtttttatgatagccaacccactcttattggactattgatcatcttccagtttattttttcaccttacaatgaggttctttctttttgcctaacagtcctaagccgcagatttgagtttcaagctgatgcatttgccaagaaacttgggaaggctaaagacttatattctgctttaatcaaacttaacaaagataacttgggattccctgtttctgactggttgttctcaatgtggcattattctcatcctccactgctagagagacttcaagctttgaaaactatgaagcaacactgagatgtccaggatctgtgactgaagacatttctgattatttctgtcctggcagcatgttccagctcttgatgtttttaaacttttttttagaagaaaaattaagtacagaaaagcccagatttaaatacatttaatatgtcattttaaaaatgattttaataattcatttcttaaaacactgaatgaattttgaagcttaatgtttttaaaggcatagttttatctttgacatctaatttaccatcaagttgtaaaattatttggaaaaatacagaactcgttttatttgtatacttatatggaatctgcatgtgaggtgtttgagggcatatgtttgaaagagggagcatcaccacaggaatcctttctgtgaggtggaaacagtggtcctgaatcattgtgctcacacctaacttgaaatctggtcttactttcatgctgttatgatttcacctggtgaatcagtgttttaaataagaaaggtaatagttggtaaggccaatgttatttaaatgaaagtagttagaaaaatgctctcctattctaccaaatttttaatttctttcttccctttcttgctacacagtgatcaagagtttctcatagtgctttgaagttagaaattatgtataggatattttaaatcattgagttttgtggggtttttttgtttgtttgtttcttttgttttttggaaaatccgtgtctttatctttttttcccacgtggtagatatgatcccattggaggtaaattgtagcttcttctcattcatgcagtaaataatacatcctttcactcagcagagatggccatattaaacacgttttgctatgttaaaagtggcagaacaggaaagacgaattaaaaataacattttttaagcgacataaggatgaaatactgatgaatctctgtgacattacagggaaaaaaatatagttttctatctctttcaagggcagaagagttttcatttttatttttgtaattttatctgtaagtcataaatattacttaatcaggcctgattctacttttgaaaattacagttcttgaaatgcagataatgtttactttgaaaacaaatgtcatgaatgatttccagtttttaaagctatatgtttcactgcttcatatctctgtccactttctgaatgagaacttattttgtgcctagagctctcactcactgataatgcttattaccttctgggcatttattccaaagtgggatcaactgtacgcctttggtatctgaccataaagtcttttgctccgctgacatttgggtgatgtcttcacatggaaatataataaaaataaaaatctagtttaatactgcattatttattttcctaaggctaaagaggagcagtcctatgcttttattcagcatcctttatctgtgacttcatgctctgataactgcctttccttccttctgtgcctttgaatacaaatttcagttctgcaaaagtgaaacattaaacattgccaacgcaaatgtatgta

SEQ ID NO: 204768 - DNA, 864 bp, Homo sapiens
  Payload ID: 20393
  Gene Name: zinc ribbon domain containing 1
  Uniprot ID: Q9P1U0
  ENST ID: ENST00000332435
  CDS Start-End: 272-652
gccgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 204769 - DNA, 743 bp, Homo sapiens
  Payload ID: 20393
  Gene Name: zinc ribbon domain containing 1
  Uniprot ID: Q9P1U0
  ENST ID: ENST00000359374
  CDS Start-End: 151-531
gggcgcagagctggcgctctagcccacggagttggttaactcctctcaccggcccctggaaagggttccaagtcctttagtacccgacgctgtctgggaattccgggcgtttcggctccttggtcgcagaggcaggaggcacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 204770 - DNA, 736 bp, Homo sapiens
  Payload ID: 20393
  Gene Name: zinc ribbon domain containing 1
  Uniprot ID: Q9P1U0
  ENST ID: ENST00000376782
  CDS Start-End: 144-524
gcgggcgcagagctggcgctctagcccacggagttggttaactcctctcaccggcccctggaaagggttccaagtcctttagtacccgacgctgtctgggaattccgggcgtttcggctccttggtcgcagagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 204771 - DNA, 754 bp, Homo sapiens
  Payload ID: 20393
  Gene Name: zinc ribbon domain containing 1
  Uniprot ID: Q9P1U0
  ENST ID: ENST00000376785
  CDS Start-End: 162-542
gcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggaggacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 204772 - DNA, 736 bp, Homo sapiens
  Payload ID: 20393
  Gene Name: zinc ribbon domain containing 1
  Uniprot ID: Q9P1U0
  ENST ID: ENST00000383613
  CDS Start-End: 144-524
gcgggcgcagagctggcgctctagcccacggagttggttaactcctctcaccggcccctggaaagggttccaagtgctttagtacccgacgctgtctgggaattccgggcgtttcggctccttggtcgcagagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacaaatgcgttcagccgatgaagggcaaactgtcttctacacctgtaccaactgcaagttccaggagaaggaagactcttgacctttttcctgggcaactctgcagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 204773 - DNA, 755 bp, Homo sapiens
  Payload ID: 20393
  Gene Name: zinc ribbon domain containing 1
  Uniprot ID: Q9P1U0
  ENST ID: ENST00000400659
  CDS Start-End: 163-543
gcagagctggcgctctagcccacggagttggttaactcctctcaccggcccctggaaagggttccaagtgctttagtacccgacgctgtctgggaattccgggcgtttcggctccttggtcgcagaggcaggagggcgtgcgtggcaggaggacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacaaatgcgttcagccgatgaagggcaaactgtcttctacacctgtaccaactgcaagttccaggagaaggaagactcttgacctttttcctgggcaactctgcagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 204774 - DNA, 744 bp, Homo sapiens
  Payload ID: 20393
  Gene Name: zinc ribbon domain containing 1
  Uniprot ID: Q9P1U0
  ENST ID: ENST00000400660
  CDS Start-End: 152-532
gggcgcagagctggcgctctagcccacggagttggttaactcctctcaccggcccctggaaagggttccaagtgctttagtacccgacgctgtctgggaattccgggcgtttcggctccttggtcgcagaggcaggagggcacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacaaatgcgttcagccgatgaagggcaaactgtcttctacacctgtaccaactgcaagttccaggagaaggaagactcttgacctttttcctgggcaactctgcagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 204775 - DNA, 865 bp, Homo sapiens
  Payload ID: 20393
  Gene Name: zinc ribbon domain containing 1
  Uniprot ID: Q9P1U0
  ENST ID: ENST00000400662
  CDS Start-End: 273-653
gccgcgggcgcagagctggcgctctagcccacggagttggttaactcctctcaccggcccctggaaagggttccaagtgctttagtacccgacgctgtctgggaattccgggcgtttcggctccttggtcgcagaggcaggagggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacaaatgcgttcagccgatgaagggcaaactgtcttctacacctgtaccaactgcaagttccaggagaaggaagactcttgacctttttcctgggcaactctgcagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 204776 - DNA, 754 bp, Homo sapiens
  Payload ID: 20393
  Gene Name: zinc ribbon domain containing 1
  Uniprot ID: Q9P1U0
  ENST ID: ENST00000451875
  CDS Start-End: 162-542
gcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggaggacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgcaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 204777 - DNA, 743 bp, Homo sapiens; identical to SEQ ID NO: 204769
  Payload ID: 20393
  Gene Name: zinc ribbon domain containing 1
  Uniprot ID: Q9P1U0
  ENST ID: ENST00000443142
  CDS Start-End: 151-531

SEQ ID NO: 204778 - DNA, 743 bp, Homo sapiens; identical to SEQ ID NO: 204769
  Payload ID: 20393
  Gene Name: zinc ribbon domain containing 1
  Uniprot ID: Q9P1U0
  ENST ID: ENST00000433264
  CDS Start-End: 151-531

SEQ ID NO: 204779 - DNA, 743 bp, Homo sapiens; identical to SEQ ID NO: 204769
  Payload ID: 20393
  Gene Name: zinc ribbon domain containing 1
  Uniprot ID: Q9P1U0
  ENST ID: ENST00000442585
  CDS Start-End: 151-531

SEQ ID NO: 204780 - DNA, 754 bp, Homo sapiens; identical to SEQ ID NO: 204771
  Payload ID: 20393
  Gene Name: zinc ribbon domain containing 1
  Uniprot ID: Q9P1U0
  ENST ID: ENST00000431416
  CDS Start-End: 162-542

SEQ ID NO: 204781 - DNA, 864 bp, Homo sapiens; identical to SEQ ID NO: 204768
  Payload ID: 20393
  Gene Name: zinc ribbon domain containing 1
  Uniprot ID: Q9P1U0
  ENST ID: ENST00000443494
  CDS Start-End: 272-652

SEQ ID NO: 204782 - DNA, 754 bp, Homo sapiens; identical to SEQ ID NO: 204771
  Payload ID: 20393
  Gene Name: zinc ribbon domain containing 1
  Uniprot ID: Q9P1U0
  ENST ID: ENST00000444027
  CDS Start-End: 162-542

SEQ ID NO: 204783 - DNA, 754 bp, Homo sapiens; identical to SEQ ID NO: 204771
  Payload ID: 20393
  Gene Name: zinc ribbon domain containing 1
  Uniprot ID: Q9P1U0
  ENST ID: ENST00000412396
  CDS Start-End: 162-542

SEQ ID NO: 204784 - DNA, 864 bp, Homo sapiens; identical to SEQ ID NO: 204768
  Payload ID: 20393
  Gene Name: zinc ribbon domain containing 1
  Uniprot ID: Q9P1U0
  ENST ID: ENST00000417275
  CDS Start-End: 272-652

SEQ ID NO: 204785 - DNA, 743 bp, Homo sapiens; identical to SEQ ID NO: 204769
  Payload ID: 20393
  Gene Name: zinc ribbon domain containing 1
  Uniprot ID: Q9P1U0
  ENST ID: ENST00000432227
  CDS Start-End: 151-531

SEQ ID NO: 204786 - DNA, 743 bp, Homo sapiens
  Payload ID: 20393
  Gene Name: zinc ribbon domain containing 1
  Uniprot ID: Q9P1U0
  ENST ID: ENST00000446493
  CDS Start-End: 151-531
gggcgcagagctggcgctctagcccacggagttggttaactcctctcaccggcccctggaaagggttccaagtcctttagtacccgacgctgtctgggaattccgggcgtttcggctccttggtcgcagaggcaggaggcacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgcaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 204787 - DNA, 864 bp, Homo sapiens
  Payload ID: 20393
  Gene Name: zinc ribbon domain containing 1
  Uniprot ID: Q9P1U0
  ENST ID: ENST00000455948
  CDS Start-End: 272-652
gccgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgcaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 204788 - DNA, 754 bp, Homo sapiens; identical to SEQ ID NO: 204771
  Payload ID: 20393
  Gene Name: zinc ribbon domain containing 1
  Uniprot ID: Q9P1U0
  ENST ID: ENST00000432545
  CDS Start-End: 162-542

SEQ ID NO: 204789 - DNA, 754 bp, Homo sapiens; identical to SEQ ID NO: 204771
  Payload ID: 20393
  Gene Name: zinc ribbon domain containing 1
  Uniprot ID: Q9P1U0
  ENST ID: ENST00000453694
  CDS Start-End: 162-542

SEQ ID NO: 204790 - DNA, 736 bp, Homo sapiens; identical to SEQ ID NO: 204770
  Payload ID: 20393
  Gene Name: zinc ribbon domain containing 1
  Uniprot ID: Q9P1U0
  ENST ID: ENST00000444794
  CDS Start-End: 144-524

SEQ ID NO: 204791 - DNA, 864 bp, Homo sapiens; identical to SEQ ID NO: 204768
  Payload ID: 20393
  Gene Name: zinc ribbon domain containing 1
  Uniprot ID: Q9P1U0
  ENST ID: ENST00000417738
  CDS Start-End: 272-652

SEQ ID NO: 204792 - DNA, 864 bp, Homo sapiens; identical to SEQ ID NO: 204768
  Payload ID: 20393
  Gene Name: zinc ribbon domain containing 1
  Uniprot ID: Q9P1U0
  ENST ID: ENST00000437373
  CDS Start-End: 272-652

SEQ ID NO: 204793 - DNA, 736 bp, Homo sapiens; identical to SEQ ID NO: 204770
  Payload ID: 20393
  Gene Name: zinc ribbon domain containing 1
  Uniprot ID: Q9P1U0
  ENST ID: ENST00000420100
  CDS Start-End: 144-524

SEQ ID NO: 204794 - DNA, 736 bp, Homo sapiens; identical to SEQ ID NO: 204770
  Payload ID: 20393
  Gene Name: zinc ribbon domain containing 1
  Uniprot ID: Q9P1U0
  ENST ID: ENST00000429558
  CDS Start-End: 144-524

SEQ ID NO: 204795 - DNA, 736 bp, Homo sapiens; identical to SEQ ID NO: 204770
  Payload ID: 20393
  Gene Name: zinc ribbon domain containing 1
  Uniprot ID: Q9P1U0
  ENST ID: ENST00000437507
  CDS Start-End: 144-524

SEQ ID NO: 204796 - DNA, 743 bp, Homo sapiens; identical to SEQ ID NO: 204769
  Payload ID: 20393
  Gene Name: zinc ribbon domain containing 1
  Uniprot ID: Q9P1U0
  ENST ID: ENST00000441251
  CDS Start-End: 151-531

SEQ ID NO: 204797 - DNA, 736 bp, Homo sapiens
  Payload ID: 20393
  Gene Name: zinc ribbon domain containing 1
  Uniprot ID: Q9P1U0
  ENST ID: ENST00000428913
  CDS Start-End: 144-524
gcgggcgcagagctggcgctctagcccacggagttggttaactcctctcaccggcccctggaaagggttccaagtcctttagtacccgacgctgtctgggaattccgggcgtttcggctccttggtcgcagagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgcaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 204798 - DNA, 864 bp, Homo sapiens; identical to SEQ ID NO: 204768
  Payload ID: 20393
  Gene Name: zinc ribbon domain containing 1
  Uniprot ID: Q9P1U0
  ENST ID: ENST00000432904
  CDS Start-End: 272-652

SEQ ID NO: 204799 - DNA, 736 bp, Homo sapiens; identical to SEQ ID NO: 204770
  Payload ID: 20393
  Gene Name: zinc ribbon domain containing 1
  Uniprot ID: Q9P1U0
  ENST ID: ENST00000431032
  CDS Start-End: 144-524

SEQ ID NO: 204800 - DNA, 922 bp, Homo sapiens
  Payload ID: 20394
  Gene Name: ZMYM6 neighbor
  Uniprot ID: Q8NCS4
  ENST ID: ENST00000373337
  CDS Start-End: 49-513
aggggcgggttttcggcggggccaacccacggtggggggagcgcggccatggcgctcctgctttcggtgctgcgtgtactgctgggcggcttcttcgcgctcgtggggttggccaagctctcggaggagatctcggctccagtttcggagcggatgaatgccctgttcgtgcagtttgctgaggtgttcccgctgaaggtatttggctaccagccagatcccctgaactaccaaatagctgtgggctttctggaactgctggctgggttgctgctggtcatgggcccaccgatgctgcaagagatcagtaacttgttcttgattctgctcatgatgggggctatcttcaccttggcagctctgaaagagtcactaagcacctgtatcccagccattgtctgcctggggttcctgctgctgctgaatgtcggccagctcttagcccagactaagaaggtggtcagacccactaggaagaagactctaagtacattcaaggaatcctggaagtagagcatctctgtctctttatgccatgcagctgtcacagcaggaacatggtagaacacagagtctatcatcttgttaccagtataatatccagggtcagccagtgttgaaagagacattttgtctacctggcactgctttctctttttagctttactactcttttgtgaggagtacatgttatgcatattaacattcctcatgtcatatgaaaatacaaaataagcagaaaagaaatttaaatcaaccaaaattctgatgccccaaataaccacttttaatgccttggtgtaagtatacctctgaacttttttctgtgcctttaaacagatatatattttttttaaatgaaaataaaaccatatatcctattttatttcctccttttaaaaccttataaactataacactg

SEQ ID NO: 204801 - DNA, 2470 bp, Homo sapiens
  Payload ID: 20395
  Gene Name: ZNF559-ZNF177 readthrough
  ENST ID: ENST00000446085
  CDS Start-End: 533-895
ggcgcatgcgcataacggccgccatcttaacagcgcgttcccgttggcgtctgaggaacagcatctctgccttcctgttcacggtgaccttcgcttggtgtcctcctggcctcagcaacctgacaattctgtcgtgtcccgggctgggtataagtaagcaagaagagggcctgggagaagagtctgacgagcaaggggaaggtagccaaggatggagtgaaatacagggtgacctgtgtttttcccctggctgctttggaaattatgggaaaaaatcaaataccaaggaagaaaaatctataatgaaattagatgtggatttctttttatgtattcagcttgggggcttatgatacttctagtacccaaagagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacatccaatggcataaacacgaatcctcatggaagagaattcctgtgaataaggtgaaagtgaaaaagcctctagtcaccacttactcccttttcaacaggcagaaaatcaacctggtgagcactccctggagtgtaaccattgtgggaaattcagaaagaacactcgctttatttgtacaagatattgcaagggagagaaatgctataaatatataaagtatagcaaagtcttcaaccatccctcaactcttaggagtcatgtgagcattcacattggagagaaaactcttgaatttactgattgtagaaaagctttcaatcaagagtcatccctcaggaaacacttaagaactcccacaggacagaagtttcaggagtatgagcaatgtgatatgtccttcagcctacactcttcctgctcagtacgtgagcaaatacctactggagagaaaggtgatgaatgcagtgactatggcaaaatatctccccttagtgtccacacaaaaactggtagtgtggaggagggtttggaatgtaatgaacatgagaaaactttcactgaccctttgtcccttcagaactgtgtcagaactcactctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcatcgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgtattcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaatattttagttatcttttcagtttaattgcattgtgaacagaacacatggtcttcaatatgtagattctgtgtgacatagatttgaacataattgctggacactgactgatgtactgtggcagacagaactagttgctgtctcaatatccattcctcccttctttcttaaagtaataaaatttaccatttagttcaa

SEQ ID NO: 204802 - DNA, 2340 bp, Homo sapiens
  Payload ID: 20395
  Gene Name: ZNF559-ZNF177 readthrough
  ENST ID: ENST00000434737
  CDS Start-End: 57-1502
tagctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacatccaatggcataaacacggcagaaaatcaacctggtgagcactccctggagtgtaaccattgtgggaaattcagaaagaacactcgctttatttgtacaagatattgcaagggagagaaatgctataaatatataaagtatagcaaagtcttcaaccatccctcaactcttaggagtcatgtgagcattcacattggagagaaaactcttgaatttactgattgtagaaaagctttcaatcaagagtcatccctcaggaaacacttaagaactcccacaggacagaagtttcaggagtatgagcaatgtgatatgtccttcagcctacactcttcctgctcagtacgtgagcaaatacctactggagagaaaggtgatgaatgcagtgactatggcaaaatatctccccttagtgtccacacaaaaactggtagtgtggaggagggtttggaatgtaatgaacatgagaaaactttcactgaccctttgtcccttcagaactgtgtcagaactcactctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcatcgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgtattcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaatattttagttatcttttcagtttaattgcattgtgaacagaacacatggtcttcaatatgtagattctgtgtgacatagatttgaacataattgctggacactgactgatgtactgtggcagacagaactagttgctgtctcaatatccattcctcccttctttcttaaagtaataaaatttaccatttagttcaagctggcaatgtggacagttttcacccagcttcccttacagctgtgagcggccaaatatgttcacatccctagcccatgcaaagtaggcagaagtcactggatacagctgctaaggaagctcatggaaatgggaatatctcatctggtgtttttttcttaactatttgccctttgtcttgtcccttatttcctagaaaatatatacaccaagaggaggacagagaaaggatactaaatgaaacaacaggggagatacaatattatctggttgcactaatcctgtgctgcttatctctggatttcatgttacatgagaaaaattaactgccatgtggtttaaaccactcttgtgggaagttcctctttcagctgatttcagtcccaactgttacatctaataaatggtcaagttttaggaatcgttc

SEQ ID NO: 204803 - DNA, 2435 bp, Homo sapiens
  Payload ID: 20395
  Gene Name: ZNF559-ZNF177 readthrough
  ENST ID: ENST00000541595
  CDS Start-End: 630-1595
gggcatttcgagcatcttgtgggctctcccaagtcgcggcccctcctctgagagccacagtcaggaacagcatctctgccttcctgttcacggtgaccttcgcttggtgtcctcctggcctcagcaacctgacaattctgtcgtgtcccgatcatctttctcaagatgttttctgtcttcatgagtcaaaatttgaagaggaaaggatggtggctgggtggttgacaaattactctcagttgctttgattagaaagtttggctttgctgagatacgtagttggaaaagagagaagcattttcagtttcttcagtgtactagatggctgactgggaagattccagggtcccaacaggcttcagagttgcgaaggctctagagggctgggtataagtaagcaagaagagggcctgggagaagagtctgacgagcaaggggaaggtagccaaggatggagtgaaatacaggagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacatccaatggcataaacacgaactgtgtcagaactcactctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcatcgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgtattcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaatattttagttatcttttcagtttaattgcattgtgaacagaacacatggtcttcaatatgtagattctgtgtgacatagatttgaacataattgctggacactgactgatgtactgtggcagacagaactagttgctgtctcaatatccattcctcccttctttcttaaagtaataaaatttaccatttagttcaagctggcaatgtggacagttttcacccagcttcccttacagctgtgagcggccaaatatgttcacatccctagcccatgcaaagtaggcagaagtcactggatacagctgctaaggaagctcatggaaatgggaatatctcatctggtgtttttttcttaactatttgccctttgtcttgtcccttatttcctagaaaatatatacaccaagaggaggacagagaaaggatactaaatgaaacaacaggggagatacaatattatctggttgcactaatcctgtgctgcttatctctggatttcatgttacatgagaaaaattaactgccatgtggtttaaaccactcttgtgggaagttcctctttcagctgatttcagtcccaactgttacatctaataaatggtcaagttttaggaatcgttcaa

SEQ ID NO: 204804 - DNA, 419 bp, Homo sapiens
  Payload ID: 20395
  Gene Name: ZNF559-ZNF177 readthrough
  ENST ID: ENST00000602856
  CDS Start-End: 57-419
tagctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacatccaatggcataaacacgaatcctcatggaagagaattcctgtga

SEQ ID NO: 204805 - DNA, 911 bp, Homo sapiens
  Payload ID: 20395
  Gene Name: ZNF559-ZNF177 readthrough
  ENST ID: ENST00000603974
  CDS Start-End: 189-524
tcctgttcacggtgaccttcgcttggtgtcctcctggcctcagcaacctgacaattctgtcgtgtcccgagagatggctaatgaatggcgcttgatgacagatgagtaatgcctgttgctgaaagattgacgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatgagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacat

SEQ ID NO: 204806 - DNA, 587 bp, Homo sapiens
  Payload ID: 20395
  Gene Name: ZNF559-ZNF177 readthrough
  ENST ID: ENST00000604886
  CDS Start-End: 1-249
atgcgcataacggccgccatcttaacagcgcgttcccgttggcgtctgaggaacagcatctctgccttcctgttcacggtgaccttcgcttggtgtcctcctggcctcagcaacctgacaattctgtcgtgtcccgggctgggtataagtaagcaagaagagggcctgggagaagagtctgacgagcaaggggaaggtagccaaggatggagtgaaatacaggagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatca

SEQ ID NO: 204807 - DNA, 597 bp, Homo sapiens
  Payload ID: 20395
  Gene Name: ZNF559-ZNF177 readthrough
  ENST ID: ENST00000605006
  CDS Start-End: 1-144
atcttaacagcgcgttcccgttggcgtctgaggaacagcatctctgccttcctgttcacggtgaccttcgcttggtgtcctcctggcctcagcaacctgacaattctgtcgtgtcccgagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaaca

SEQ ID NO: 204808 - DNA, 725 bp, Homo sapiens
  Payload ID: 20395
  Gene Name: ZNF559-ZNF177 readthrough
  ENST ID: ENST00000605071
  CDS Start-End: 253-507
gaaaggggaggtgcccagtgaaatggagcctgtcccgtgcactttcgggcatttcgagcatcttgtgggctctcccaagtcgcggcccctcctctgagagccacagtcaggaacagcatctctgccttcctgttcacggtgaccttcgcttggtgtcctcctggcctcagcaacctgacaattctgtcgtgtcccgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatgggctgggtataagtaagcaagaagagggcctgggagaagagtctgacgagcaaggggaaggtagccaaggatggagtgaaatacagggtgacctgtgtttttcccctggctgctttggaaattatgggaaaaaatcaaataccaaggaagaaaaatctataatgaaattagatgtggatttctttttatgtattcagcttgggggcttatgatacttctagtacccaaag

SEQ ID NO: 204809 - DNA, 586 bp, Homo sapiens
  Payload ID: 20395
  Gene Name: ZNF559-ZNF177 readthrough
  ENST ID: ENST00000593242
  CDS Start-End: 1-204
ctgaggaacagcatctctgccttcctgttcacggtgaccttcgcttggtgtcctcctggcctcagcaacctgacaattctgtcgtgtcccgggctgggtataagtaagcaagaagagggcctgggagaagagtctgacgagcaaggggaaggtagccaaggatggagtgaaatacaggagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtaggtaaggctggcctcatttcttcatttgtttatgtagcaaatagttcttaagcacatattatgttccagaatctgtggaaagaatagc

SEQ ID NO: 204810 - DNA, 604 bp, Homo sapiens
  Payload ID: 20395
  Gene Name: ZNF559-ZNF177 readthrough
  ENST ID: ENST00000605775
  CDS Start-End: 1-162
atgcgcataacggccgccatcttaacagcgcgttcccgttggcgtctgaggaacagcatctctgccttcctgttcacggtgaccttcgcttggtgtcctcctggcctcagcaacctgacaattctgtcgtgtcccgagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacaggtacacaagaaatttctctatttccaaaagcacactgccattcctgaaaagaacacatctcttgcccctgacctgaagcttcacagcccaatctgagctggcttcatcttccgcagctcccaggctgcttcatgtggaagagggaatccctgggaaaggcttctgttcccacatttgttaactttctccagatattcttccatatttttgagtatgaattccatactgtagtgagtgctgtaaagaaagacttttactaggaaaattatttatc

SEQ ID NO: 204811 - DNA, 827 bp, Homo sapiens
  Payload ID: 20395
  Gene Name: ZNF559-ZNF177 readthrough
  ENST ID: ENST00000603656
  CDS Start-End: 449-827
ggtggaaaggggaggtgcccagtgaaatggagcctgtcccgtgcactttcgggcatttcgagcatcttgtgggctctcccaagtcgcggcccctcctctgagagccacagtcaggaacagcatctctgccttcctgttcacggtgaccttcgcttggtgtcctcctggcctcagcaacctgacaattctgtcgtgtcccgggctgggtataagtaagcaagaagagggcctgggagaagagtctgacgagcaaggggaaggtagccaaggatggagtgaaatacaggagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacatccaatggcataaacacgaactgtgtcagaactcactctggagagatgccctatgaatgca

SEQ ID NO: 204812 - DNA, 585 bp, Homo sapiens
  Payload ID: 20395
  Gene Name: ZNF559-ZNF177 readthrough
  ENST ID: ENST00000604543
  CDS Start-End: 1-200
tcttaacagcgcgttcccgttggcgtctgaggaacagcatctctgccttcctgttcacggtgaccttcgcttggtgtcctcctggcctcagcaacctgacaattctgtcgtgtcccggcaggagtacagtggtgagatcacggttcactgcagcattgacctccctaggctcaggtgttgctcccacctcagtcttctgaatagcttggagtatagattgggagagtcatattaataccaaatggtcagcacctcagcagaattttttgcaggggaaaacatccagtgtggtggaaatgagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgt

SEQ ID NO: 204813 - DNA, 591 bp, Homo sapiens
  Payload ID: 20395
  Gene Name: ZNF559-ZNF177 readthrough
  ENST ID: ENST00000605093
  CDS Start-End: 1-139
aacagcgcgttcccgttggcgtctgaggaacagcatctctgccttcctgttcacggtgaccttcgcttggtgtcctcctggcctcagcaacctgacaattctgtcgtgtcccgagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcaggtgagccttgggcagaacagggtgcagccttggccagtgagggttagtacatttgggaatgtca

SEQ ID NO: 204814 - DNA, 610 bp, Homo sapiens
  Payload ID: 20395
  Gene Name: ZNF559-ZNF177 readthrough
  ENST ID: ENST00000603024
  CDS Start-End: 1-231
atgcgcataacggccgccatcttaacagcgcgttcccgttggcgtctgaggaacagcatctctgccttcctgttcacggtgaccttcgcttggtgtcctcctggcctcagcaacctgacaattctgtcgtgtcccgattgggagagtcatattaataccaaatggtcagcacctcagcagaattttttgcaggggaaaacatccagtgtggtggaaatgggctgggtataagtaagcaagaagagggcctgggagaagagtctgacgagcaaggggaaggtagccaaggatggagtgaaatacagggtgacctgtgtttttcccctggctgctttggaaattatgggaaaaaatcaaataccaaggaagaaaaatctataatgaaattagatgtggatttctttttatgtattcagcttgggggcttatgatacttctagtacccaaagagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaaga

SEQ ID NO: 204815 - DNA, 2651 bp, Homo sapiens
  Payload ID: 20396
  Gene Name: ZNF625-ZNF20 readthrough (NMD candidate)
  ENST ID: ENST00000430024
  CDS Start-End: 174-551
gctttcctgactcccaggcgtcttgcaccaaagggaggtcgggatctcggttttccggccccgagagggaccaggtgcctccgccatagcttctgtcgctccatcgcccgcactgtgactggactgttagagggatccgtggagaggaggccaggacacctggaagccgggaaatggattcagtggtctttgaggatgtagatgtgaacttcacccaggaggagtgggctttgctggatccttcccagaagaatctctacagagatgtgatgcaggaaaccttcaggaacctggcttctgtaggaaaaaaatggaaagatcagaaaattgaagatgagtacaaaaatcccaggagaaacctaagtcttagaaagtggagttggtcgctgtacgcaagacagacattggggctggactcaccatcagtggccccgaaaaggttgttgtcgggataccagatttcctactccgagaggccccgggtccctctgccacaacttctgtcgctctgccgcctgcaccgtgacccgcactattcacgggagccctagagaggacaccgggacacccagaagccgggaaatgatgtttcaggattcagtggcctttgaggatgtggctgtcagcttcacccaggaggagtgggctttgctggatccttcccagaagaatctctacagggatgtgatgcaggaaaccttcaagaacctgacctctgtaggaaaaacatggaaagttcagaacattgaagatgagtacaaaaatcccaggagaaatctaagtcttatgagagagaaactctgtgaaagtaaagaaagtcatcactgtggagaaagcttcaaccagattgcagatgacatgctgaacaggaaaactcttcctggaataacaccatgtgaaagcagtgtgtgtggagaagttggcacgggtcattcatctcttaatacgcatatcagagctgacactggacacaagtcatctgagtatcaggaatatggagagaatccatatagaaataaggaatgtaagaaagccttcagttatcttgactcctttcaatcacatgataaagcttgcactaaagagaaaccctatgatggtaaagaatgtacagaaaccttcatttcccattcatgcattcaaagacacagggtaatgcacagtggagatggaccttataaatgtaagttttgtgggaaagccttctattttctcaatttatgtcttatccatgaacgaattcacactggtgtgaaaccatataagtgtaaacaatgtggtaaggcctttactcgttccactacccttccagtacatgaaagaactcacacaggagtgaatgccgatgaatgtaaagaatgtgggaatgcattcagttttcctagtgaaattcgtagacataaaaggtctcacactggagaaaaaccctatgagtgtaagcaatgtgggaaagtcttcatttctttcagttccattcagtatcataagatgactcacactggagagaaaccctatgaatgtaagcagtgtgggaaagcctttagatgtggctcacaccttcaaaagcatggaaggactcacactggagagaaaccctatgaatgtaggcaatgtggtaaagccttcagatgtacctcggaccttcaaaggcatgaaaagacacacactgaggataaaccctatggatgtaagcagtgtgggaaaggctttagatgtgcttcacaacttcaaattcatgaaaggacgcacagtggagagaaaccccatgaatgtaaggaatgtggaaaagtattcaagtatttttcttccttgcgtatacatgaaaggacgcacactggagagaagccccatgaatgtaagcaatgtggaaaagcattcaggtatttctcttccttgcatatacatgaaaggacacacactggagataagccatatgagtgtaaggtatgtggcaaagccttcacttgttccagttccattcgatatcatgaaaggactcacactggagagaaaccctatgaatgtaagcactgtggtaaggcctttatttccaattacattcgatatcatgaaaggactcacactggagagaaaccctatcaatgcaagcaatgtggcaaagcctttattcgtgccagttcatgtcgagaacatgaaagaactcataccattaatagatgagaaatccttttagtggaagcaacgggagaagctttctgttgtcccacttcctttgaaacacaagaaaagagagtggtgaaagaacctctggataactgctttttgaattgagaagagagacttgcgataggacaataaaatctagaagaacttggatggtttcgtaatacaattcacctatagccaatcttgcatgagatttcaaaggcacagaaaaggaaggcatcagtcacatattagaggccccacacagggagagaggtgtgtggctacccgcttccagcccattttcctgattctttggcttgttaatcgagaatatcccccaaatcacttgtctctgttcctcagagttgtaggtctccagatatgtccccagtgctccacattaaagatacatgcccactttgctgtttcttcagaaatgttaaaatgtttaccagagaactaataaatgttgttatggctgg

SEQ ID NO: 204816 - DNA, 1532 bp, Homo sapiens
  Payload ID: 20396
  Gene Name: ZNF625-ZNF20 readthrough (NMD candidate)
  ENST ID: ENST00000434822
  CDS Start-End: 174-359
gctttcctgactcccaggcgtcttgcaccaaagggaggtcgggatctcggttttccggccccgagagggaccaggtgcctccgccatagcttctgtcgctccatcgcccgcactgtgactggactgttagagggatccgtggagaggaggccaggacacctggaagccgggaaatggattcagtggtctttgaggatgtagatgtgaacttcacccaggaggagtgggctttgctggatccttcccagaagaatctctacagagatgtgatgcaggaaaccttcaggaacctggcttctgaaaaaaatggaaagatcagaaaattgaagatgagtacaaaaatcccaggagaaacctaagaggtcttatgggagagagactcttagaaagtaagaaagatcatcagcatggagaaattttgacccaggttccagatgacatgctgaagaagaaaactccccgagtaaaatcatgtggagaagtcagcgtgggtcatgcatcccttaataggcaccacagagctgacactggacacaagccatatgagtatcaggaatatggacagaagccatataaatgtacatactgtaagaaagccttcagtgatctcccctactttcgaacacatgaatgggctcacactggggggaaaccttatgattgtgaggaatgtggaaaaagctttatttcccgttcaagcattcgaagacacaggataatgcacagtggagatggaccctacaaatgtaacttttgtgggaaagccttgatgtgtctcagtttgtatcttatccacaaacgaactcacactggagagaaaccatatgaatgtaaacagtgtggtaaagcctttagtcattctggtagccttcgaatacatgaaagaactcacactggagagaagccttatgaatgcagtgagtgtgggaaagcattccatagttccacatgcctccatgcacataaaataactcacactggggagaagccgtatgaatgtaaacagtgtgggaaagcctttgtttctttcaattccgttcgatatcatgaaagaactcacactggagagaagccctatgaatgtaagcaatgtgggaaagccttcagatctgcctcgcaccttcgaacacatggaaggactcacactggagagaaaccctatgaatgtaaacaatgtggtaaagcctttggatgtgcctcgagcgttaaaatccatgaaaggactcacactggagaaaaaccctgtagctccaacacttcgaaaggccaaggcgagaagattgcttaattcacataagattcctagaagccaccgaatccaatcatgaaattatgtgtaccatttcagtcttagaaagtggagttggtcgctgtacgcaagacagacattggggctggactcaccatcagtggccccgaaaaggttgttgtcgggataccagatttcctactccgagaggccccgggtccctctgccacaacttctgtcgctctgccgcctgcaccgtgacccgcactattcacgggagccc

SEQ ID NO: 204817 - DNA, 2751 bp, Homo sapiens
  Payload ID: 20397
  Gene Name: ZNF670-ZNF695 readthrough (NMD candidate)
  ENST ID: ENST00000474541
  CDS Start-End: 216-572
actctcaagcgcgccgcgaaaggagggagcagcttccgggacctggcgcggcttttgtgttgggcagcgcgaatgtggcgagctcggtgcgtctccgctgctccttccccttatccctgggaggtccaagtggtcccgcggcagcttctgttgctctgggacctgcaggtcccggaaggtccttagggaggaccccagacaccggagactgggaaatgggactattggcattcagggatgtggctctagaattctctccagaggagtgggaatgcctggacccagctcagcggagtttgtatagggatgtgatgttagagaactacagaaacctgatctcccttggtcttgctatgtctaagccagaactgatcatctgtctggaggcaaggaaagagccctggaacgtgaacacagagaagacagccagacactcagtagagacgaggtttcgccatgttggccaggctggtctcaaactccttacctcaggtgatccacctgccttggcctcccaaagtgctgggattacaggcacgggccaccactgccagcctatttgtgtattctgaattatatttaaccattcatttggtgagttttgtcttcttatcttactgaagacattttgccagagcagggcctgcaagtttcattccaaaaagtgatgctgagaagatatgaaagatgttgtcttgagaaattacgcttaaggaatgactgggaaattgtggattatccagactcaggtagttctttataacaatgtgagaatgaactaatacagaaaagtggtaccagagagttgggacattgctataaagatacctgaaaatgtggaagtgactttggaactgggtaacaggcagaagttggaagagtttggagggctcagaagaagacaggaagataaggaaaagtttggaacttcctagagacttgttgaatggttgtaaccaaaatgctgatggtgatatggacaatgaagtccaggctgaggagttctcagatggagatgaggaccttattgggagctacagtaaaggtcactcttgctatgctttagcaaagagactagtggcattgtgcccctgctatagggatctgttgaactttgaacttgagagagatgatttagggtatctggcagaaaatatttctaagtagcaaagcattcaagatatggcctggctccttctaacagtgtatgctcatatttctgaggaaagagattatctgaaactggaacttacatttaaaagggaaatggagtattaaagtttggaaatgtgcagcctagccatgtattagaaaagaaaaaaccattttctggggaggaattcaacctagctgcaaaaatttgtgtaagtaaagaggagccgtatgttaacagccaagacaatgggaaaaatgcccccaagacatttcagagactttcgtggcagcccctctcatcacaggcctggaggcctaggagggaaaaacagttttgtgggtcaggcttagggccctgctattctgtgcagccttgggaccctgttccctgtgctttagctgctccagctccagccatggctaaaaggactccagatatgtttcaggttgctgctccagagggtataagacacaagccttggaggcttccagatggtgttaagcctgcaggtgctcagagggcaagagttgaggcttgggagcctccattctttcagatttctgaggatgtatggaaacaactggatatccaggcagaaatttgcttcaggggcggagcccttgtggagaacctctactagggtactgtggaggggaaatatggggttgaagtccccacaaagagtctccactggggcactgccaagtggagctgtgagaagagggccactgtcctccacaccccagaatggtagctccatcaacagtttgcactgtgtgcttggaaaagccacaggcactcaacaccagcctgtgagagcggccatggggcactaagccctgcagagccgccagaagcagagctgtccaagaccttgggagcctaccccttgcatcagtgtggcctggatgttagacatggaatcaaaggatattattttggagctctaagatttaatgactgccctgctgggtttcggacttgcatggggcctgtaacccctttgttttggccaatgtctcccttttggaacaggaacatttacccaatgcctgtacccttattgtatcctagatgtaactaacttgcttttgattttacaggctcataggcagaagggactgccttatctcagatgaaactttggacttggacttttgagttaatgctgaaatgagttaagactttgggagactgtttggaaagcataattgtgttttgaaatgtgaggacatgatatttgggatgggccaggagtggaatgatatggtttggctctgtgtccccacccaaatttcatgtcaaattgtaatcttcaatgttggaggagggtcctggtgggaaggtaattggatcatgggggcagacttctcctttgctgttctcatgatgagtgagttctcatgatacttgattgtttaaaagtgtatagcatttccccctttgctctctctctcctgccagccatgtgaagatgtgcttgcttcccctttgccttctgccatgattctaagtttcctgaggcctccccagaagcagaagcatgtaaagcccacagaaccgtgagttgattaaatctcttttctttataaatt

SEQ ID NO: 204818 - DNA, 1042 bp, Homo sapiens
  Payload ID: 20397
  Gene Name: ZNF670-ZNF695 readthrough (NMD candidate)
  ENST ID: ENST00000465049
  CDS Start-End: 141-554
tggcgagctcggtgcgtctccgctgctccttccccttatccctgggaggtccaagtggtcccgcggcagcttctgttgctctgggacctgcaggtcccggaaggtccttagggaggaccccagacaccggagactgggaaatgggactattggcattcagggatgtggctctagaattctctccagaggagtgggaatgcctggacccagctcagcggagtttgtatagggatgtgatgttagagaactacagaaacctgatctcccttggtcttgctatgtctaagccagaactgatcatctgtctggaggcaaggaaagagccctggaacgtgaacacagagaagacagccagacactcagttttgtcttcttatcttactgaagacattttgccagagcagggcctgcaagtttcattccaaaaagtgatgctgagaagatatgaaagatgttgtcttgagaaattacgcttaaggaatgactgggaaattgtggtagagacggggtttcaccgtgttagccaggatggtctcaatctcctgacctcgtgatccgcctgtctcggcctcccaaagtgctgggattacagacgtgagccactgcacccggccagcataagatttttatatgagtaattgggaaggcttctataaatataagccatgtgaagatgtgcttgcttcccctttgccttctgccatgattctaagtttcctgaggcctccccagaagcagaagcatgtaaagcccacagaaccggtccagtcgtcgaccatcgagctgctttgaagaccctgcggaggttccgtcgctgcttgaacacagtgcctggactccctgctccgtgaggcgaatttacaccgggtccagctgcgtcagcccgagttctgaattaaaacatgcctcccacagaatctatttctgatgaatatgaaaggaagattgttcttccatgttggtttttattgagatatctctttttttcccttttcatttggttgtcctaactccatgaatagaaaagaaaatgtattaattc

SEQ ID NO: 204819 - DNA, 1252 bp, Homo sapiens
  Payload ID: 20398
  Gene Name: ZNF816-ZNF321P readthrough
  Uniprot ID: Q8N8H1
  ENST ID: ENST00000391777
  CDS Start-End: 123-824
agttgtctggtgctgctatataggggacgtggggtccccacagacctgcaggttccggcccctcttttctcaacccagagcaaattgaaacgtccgggtgagagtccgatttccaaagactcatgttacgtgaggaagccaccaagaagagcaaagaaaaggagccagggatggctcttcctcagggacgcttgactttcagggatgtggctatagagttctctttggaggagtggaaatgcctgaaccctgcacagagggctttatacagggctgtgatgttggagaactacaggaacctggagtttgtggatatctcttccaaatgcatgatgaaggagttctcatccacagcgcaaggcaatacagaagtgatccacacagggacattgcaaagacatgaaagtcatcacattagagatttttgcttccaggaaattgagaaagatattcataactttgagtttcagtggcaagaagaggaaaggaatggtcacgaagcacccatgacagaaatcaaagagttgactggtagtacagaccgacatgatcaaaggcatgctggaaacaagcctattaaagatcagcttggatccagctttcattcgcatctgcctgaactccacatatttcagcctgaatggaaaattggtaatcaagttgagaagtctatcatcaatgcctccttaattttgacatcccaaagaatttcttgtagtcccaaaacccgtatttctaataactatgggaataattccctccattcttcattacccatacaaaaattgggaagtacacatgagagaaaaatctttccaatgtaatgagagtggcaaatcctttaattatagctaactcttaaggaaatatcagataatccatttaggatagaaacaatataaatgtgaggtatgtgacaaggtctttaatcagaattgattccttgtatgccataatagatgtcacactggtaagaaaccttacagttgttatgagtgtggcaagaccttcagtcagacgtcatcctttacatgctatcgtagacttcatactggagggaaaccttacaagtgtagtgagcataacaagacctttggttgaaattcagcccttgtaattcataaggcaattcatactggagagaatccttgcaagtgtaatgaatgtggcaaggtttttaatcagaaagcacaccttgcacgtcatcatagacttcatactagagagaagccttacaaatgtgaagaatgtg

SEQ ID NO: 204820 - DNA, 1213 bp, Homo sapiens
  Payload ID: 20399
  Gene Name: zona pellucida binding protein
  Uniprot ID: Q9BS86
  ENST ID: ENST00000046087
  CDS Start-End: 71-1126
ggctgcaggtgggcgcgcgttgcctaacgaccttccgcgcggacggtgggcaggcgacggcggcgtgtggatggaggccttcgcccttggcccagcgcggcggggcaggcggcggacccgggccgccggctccctgctctctcgggccgccatcctcctctttatctccgccttcctggtgcgggtgccctcatcagttggacacttggttcgattaccaagagcttttcgcttgaccaaagattcagtgaaaatagtgggatcaacaagttttccagtgaaagcgtatgtcatgctccatcaaaagagtccacacgtgttatgtgtaacgcaacaactgcgaaatgctgaactgatagacccatcattccaatggtatgggcctaaaggaaaagttgtttcagtagaaaaccgcactgcacaaataacatccacaggaagccttgtattccaaaattttgaggagagtatgagtggaatttatacatgtttcctcgaatataaacctactgtggaagaaattgttaaacgtcttcaactaaaatatgctatatatgcttatcgtgagcctcattattattatcagttcacagctcgatatcatgcagctccctgcaatagcatttataatatttcttttgagaagaaacttcttcagattttaagcaaactgcttcttgacctttcatgtgaaatttccttacttaagtctgaatgccatcgcgttaaaatgcaaagagctggtttgcaaaatgaattgttctttgcattttcagtttcatctctagacactgaaaaaggacccaagcgatgtacagaccataactgtgaaccttacaaaagactttttaaggctaaaaatctcatagagagattttttaatcaacaagtagaaattcttggcagacgtgcagaacaattacctcaaatatactatattgaaggtactctccaaatggtttggattaatcgctgctttccaggatatggaatgaatgtccagcaacatccaaaatgtcctgagtgctgtgtgatctgcagccctggatcatataacccccgtgatggaattcattgccttcaatgcaatagcagcctggtgtatggagcaaaaacgtgcttataagccattatcttcagttattcagtggtttattaaatgcaaagtatatatttgaaatattaacataataaattattatgccaaaattaa

SEQ ID NO: 204821 - DNA, 589 bp, Homo sapiens
  Payload ID: 20399
  Gene Name: zona pellucida binding protein
  ENST ID: ENST00000450231
  CDS Start-End: 373-589
tagattacagtttattacatacgtaggagagtggcttcttcccatttaaaccctggaaaatataattggctacaaatttcaagattttttcccaatttatggattaccttcaagttccatacaactggcaccatctaccaacaagagtgagcatccaggaacctcgttagaaacttttctcagtggaaattaacttatcttcattccactttaagtgtgcaagacttgcaaataaaggtcgtgtcttaaaagcggctcagatgaaactaccaatttggctgctgctgctaccgcttttaaacaattaaaatatggcttagctactgagtccaatcacaggctataatatgtgattggcctctattttccttcatgtttttggttggacacttggttcgattaccaagagcttttcgcttgaccaaagattcagtgaaaatagtgggatcaacaagttttccagtgaaagcgtatgtcatgctccatcaaaagagtccacacgtgttatgtgtaacgcaacaactgcgaaatgctgaactgatagacccatcattccaatggtatgggcctaaaggaaaagttgtttcag

SEQ ID NO: 204822 - DNA, 1095 bp, Homo sapiens
  Payload ID: 20399
  Gene Name: zona pellucida binding protein
  Uniprot ID: Q9BS86
  ENST ID: ENST00000419417
  CDS Start-End: 43-1095
gaccttccgcgcggacggtgggcaggcgacggcggcgtgtggatggaggccttcgcccttggcccagcgcggcggggcaggcggcggacccgggccgccggctccctgctctctcgggccgccatcctcctctttatctccgccttcctggtgcgggtgccctcatcagttggacacttggttcgattaccaagagcttttcgcttgaccaaagattcagtgaaaatagtgggatcaacaagttttccagtgaaagcgtatgtcatgctccatcaaaagagtccacacgtgttatgtgtaacgcaacaactgcgaaatgctgaactgatagacccatcattccaatggtatgggcctaaaggaaaagttgtttcagaaaaccgcactgcacaaataacatccacaggaagccttgtattccaaaattttgaggagagtatgagtggaatttatacatgtttcctcgaatataaacctactgtggaagaaattgttaaacgtcttcaactaaaatatgctatatatgcttatcgtgagcctcattattattatcagttcacagctcgatatcatgcagctccctgcaatagcatttataatatttcttttgagaagaaacttcttcagattttaagcaaactgcttcttgacctttcatgtgaaatttccttacttaagtctgaatgccatcgcgttaaaatgcaaagagctggtttgcaaaatgaattgttctttgcattttcagtttcatctctagacactgaaaaaggacccaagcgatgtacagaccataactgtgaaccttacaaaagactttttaaggctaaaaatctcatagagagattttttaatcaacaagtagaaattcttggcagacgtgcagaacaattacctcaaatatactatattgaaggtactctccaaatggtttggattaatcgctgctttccaggatatggaatgaatgtccagcaacatccaaaatgtcctgagtgctgtgtgatctgcagccctggatcatataacccccgtgatggaattcattgccttcaatgcaatagcagcctggtgtatggagcaaaaacgtgcttataa

SEQ ID NO: 204823 - DNA, 491 bp, Homo sapiens
  Payload ID: 20399
  Gene Name: zona pellucida binding protein
  ENST ID: ENST00000413331
  CDS Start-End: 39-266
ttccgcgcggacggtgggcaggcgacggcggcgtgtggatggaggccttcgcccttggcccagcgcggcggggcaggcggcggacccgggccgccggctccctgctctctcgggccgccatcctcctctttatctccgccttcctggtgcgggtgccctcatcaggtgagggtccgcgccgccctgccggctccgcagggacaaccgcagcttcccccactcttcgaattgccttttcttgtgtcacgtgcatccgttttatatagagacaccttgctcactaatacgtgacaagaaaggcttattttttatggaagtcgtacaaagtcactctgcatttgcatagaggagtgaatgacaggaaattaagttggacacttggttcgattaccaagagcttttcgcttgaccaaagattcagtgaaaatagtgggatcaacaagttttccagtgaaagcgtatgtcatgctccatcaaaagagtccacacgt

SEQ ID NO: 204824 - DNA, 1543 bp, Homo sapiens
  Payload ID: 20400
  Gene Name: zona pellucida binding protein 2
  Uniprot ID: Q6X784
  ENST ID: ENST00000348931
  CDS Start-End: 192-1208
ccccgcgcgcgagaatcgaagcacgcacgcgttctcctgcgcgtccgctcccgccgttgcgacggacgggtaggggaggcgaccccggcgttctgctccgcactgtggaggaggtggggaggtgttgggccagggctgaggtaggagggagtctgtccctcgacgcctcctgcgacgccagcccctgagcgatgatgcgaacgtgcgtcctactctccgcggtgctctggtgcctcacaggagtccaatgcccgcgttttaccttattcaataagaagggcttcatttatggcaagacaggacagccagacaaaatatatgtagagttacatcaaaatagtccagtccttatctgtatggattttaagctttctaaaaaagaaatagtggaccccacctacttatggattgggcctaatgaaaagacgttaacaggaaataatagaataaatataactgaaactggacagctgatggtgaaagattttttggagcctttgtctggactttacacatgtactctttcttataagactgttaaagcagaaactcaagaagaaaaaacagtcaaaaagagatatgactttatggtctttgcctatcgggaacctgattattcatatcagatggctgtacgttttaccacaaggtcttgtatagggagatacaatgatgtattctttagagtgctgaagaaaatcttggatagtctaatttctgatttgtcatgccatgtcatagagccatcatataaatgccattctgttgaaattccagaacatggcctcatacatgagctatttatagcatttcaagttaatccttttgcgccggggtggaaaggtgcttgcaatggatctgttgactgtgaagataccactaatcataatatcctccaggcaagagatcgaatagaagacttttttcggagccaagcatatattttctaccataactttaataaaactctaccagcaatgcattttgtggaccacagtttgcaagtagtacgtctggatagctgtcgaccaggctttggaaaaaatgaacgtctacacagtaattgcgctagctgttgtgtggtttgtagtcctgcgacttttagtcctgatgttaatgtaacttgtcagacctgcgtttccgtccttacctatggagctaaatcttgcccacaaacttcaaacaaaaatcagcaatatgaagattagaggtgaaagcattgttacttacttgtggaagtcggggacataagatgattttcacatcccagagcatcatagatagttccattaagtaaaatcagtaagaccaaaccactggaaaacatgcattttggaaactttaaaataaatggttaacatggcatttctaagaaggcatttaatccagtatctctagtgtacaaaggaaacttgaagttttaatggattatttttaatgaaatgttttattgtttacaaacggtatgttgctgtgtacctaagagtatagtaaggtcaagaagagtatcaaagtataataaaataaaaattgtatactctcc

SEQ ID NO: 204825 - DNA, 2177 bp, Homo sapiens
  Payload ID: 20400
  Gene Name: zona pellucida binding protein 2
  Uniprot ID: Q6X784
  ENST ID: ENST00000377940
  CDS Start-End: 140-1090
gccgttgcgacggacgggtaggggaggcgaccccggcgttctgctccgcactgtggaggaggtggggaggtgttgggccagggctgaggtaggagggagtctgtccctcgacgcctcctgcgacgccagcccctgagcgatgatgcgaacgtgcgtcctactctccgcggtgctctggtgcctcacaggagacaaaatatatgtagagttacatcaaaatagtccagtccttatctgtatggattttaagctttctaaaaaagaaatagtggaccccacctacttatggattgggcctaatgaaaagacgttaacaggaaataatagaataaatataactgaaactggacagctgatggtgaaagattttttggagcctttgtctggactttacacatgtactctttcttataagactgttaaagcagaaactcaagaagaaaaaacagtcaaaaagagatatgactttatggtctttgcctatcgggaacctgattattcatatcagatggctgtacgttttaccacaaggtcttgtatagggagatacaatgatgtattctttagagtgctgaagaaaatcttggatagtctaatttctgatttgtcatgccatgtcatagagccatcatataaatgccattctgttgaaattccagaacatggcctcatacatgagctatttatagcatttcaagttaatccttttgcgccggggtggaaaggtgcttgcaatggatctgttgactgtgaagataccactaatcataatatcctccaggcaagagatcgaatagaagacttttttcggagccaagcatatattttctaccataactttaataaaactctaccagcaatgcattttgtggaccacagtttgcaagtagtacgtctggatagctgtcgaccaggctttggaaaaaatgaacgtctacacagtaattgcgctagctgttgtgtggtttgtagtcctgcgacttttagtcctgatgttaatgtaacttgtcagacctgcgtttccgtccttacctatggagctaaatcttgcccacaaacttcaaacaaaaatcagcaatatgaagattagaggtgaaagcattgttacttacttgtggaagtcggggacataagatgattttcacatcccagagcatcatagatagttccattaagtaaaatcagtaagaccaaaccactggaaaacatgcattttggaaactttaaaataaatggttaacatggcatttctaagaaggcatttaatccagtatctctagtgtacaaaggaaacttgaagttttaatggattatttttaatgaaatgttttattgtttacaaacggtatgttgctgtgtacctaagagtatagtaaggtcaagaagagtatcaaagtataataaaataaaaattgtatactctccatatatttatttgtttggaatcactcttgtgtgatataaaggcgtgtatattatctttgtattagaaccaaaaaagttatttattttggtccctatgattttattttttaagataaattaatatactgtattttttaaagtataggtttaggtttacagaataatagagcagataatatatagagttccatacacccactgcaccccataccctcattcctccttacacaatttctcctattattaagatggtgcattagtgtggcacatttgttacaaatgatgaaccaatattaatttattattaattatagcccatagttcacattaagattcattgtgttgtaaggttatgtgggttttgacaaattcataatggcatgtgtgcaccattgcagtctcatacagaatagtttcaccaccctcaaaatcctgtgcttcacttatttatccctcccgccgtgccctggcaaccactgatctttttactgtctctacagttttgccttttccaaaatgtcatgtagttggttggagttatgcagtatgtagactttttagactggcttctttcacttagcaatatgcatttaaggttcctccatgtctttttgtgacttgatagctcattttttattgctgaataatgttcattgtatggatatagcatagtatgtttatccattcgcccattaaaggaaatcttgattgcttccagttttcagtgattaaaaataaagccgctataaaca

SEQ ID NO: 204826 - DNA, 1277 bp, Homo sapiens
  Payload ID: 20400
  Gene Name: zona pellucida binding protein 2
  ENST ID: ENST00000584588
  CDS Start-End: 140-937
gccgttgcgacggacgggtaggggaggcgaccccggcgttctgctccgcactgtggaggaggtggggaggtgttgggccagggctgaggtaggagggagtctgtccctcgacgcctcctgcgacgccagcccctgagcgatgatgcgaacgtgcgtcctactctccgcggtgctctggtgcctcacaggagtccaatgcccgcgttttaccttattcaataagaagggcttcatttatggcaagacaggacagccagacaaaatatatgtagagttacatcaaaatagtccagtccttatctgtatggattttaagctttctaaaaaagaaatagtggaccccacctacttatggattgggcctaatgaaaagacgttaacaggaaataatagaataaatataactgaaactggacagctgatggtgaaagattttttggagcctttgtctggactttacacatgtactctttcttataagactgttaaagcagaaactcaagaagaaaaaacagtcaaaaagagatatgactttatggtctttgttaatccttttgcgccggggtggaaaggtgcttgcaatggatctgttgactgtgaagataccactaatcataatatcctccaggcaagagatcgaatagaagacttttttcggagccaagcatatattttctaccataactttaataaaactctaccagcaatgcattttgtggaccacagtttgcaagtagtacgtctggatagctgtcgaccaggctttggaaaaaatgaacgtctacacagtaattgcgctagctgttgtgtggtttgtagtcctgcgacttttagtcctgatgttaatgtaacttgtcagacctgcgtttccgtccttacctatggagctaaatcttgcccacaaacttcaaacaaaaatcagcaatatgaagattagaggtgaaagcattgttacttacttgtggaagtcggggacataagatgattttcacatcccagagcatcatagatagttccattaagtaaaatcagtaagaccaaaccactggaaaacatgcattttggaaactttaaaataaatggttaacatggcatttctaagaaggcatttaatccagtatctctagtgtacaaaggaaacttgaagttttaatggattatttttaatgaaatgttttattgtttacaaacggtatgttgctgtgtacctaagagtatagtaaggtcaagaagagtatcaaagtataataaaataaaaattgtatactctccatata

SEQ ID NO: 204827 - DNA, 795 bp, Homo sapiens
  Payload ID: 20400
  Gene Name: zona pellucida binding protein 2
  ENST ID: ENST00000583811
  CDS Start-End: 140-795
gccgttgcgacggacgggtaggggaggcgaccccggcgttctgctccgcactgtggaggaggtggggaggtgttgggccagggctgaggtaggagggagtctgtccctcgacgcctcctgcgacgccagcccctgagcgatgatgcgaacgtgcgtcctactctccgcggtgctctggtgcctcacaggagcctatcgggaacctgattattcatatcagatggctgtacgttttaccacaaggtcttgtatagggagatacaatgatgtattctttagagtgctgaagaaaatcttggatagtctaatttctgatttgtcatgccatgtcatagagccatcatataaatgccattctgttgaaattccagaacatggcctcatacatgagctatttatagcatttcaagttaatccttttgcgccggggtggaaaggtgcttgcaatggatctgttgactgtgaagataccactaatcataatatcctccaggcaagagatcgaatagaagacttttttcggagccaagcatatattttctaccataactttaataaaactctaccagcaatgcattttgtggaccacagtttgcaagtagtacgtctggatagctgtcgaccaggctttggaaaaaatgaacgtctacacagtaattgcgctagctgttgtgtggtttgtagtcctgcgacttttagtcctgatgttaatgtaacttgtcagacctgcgtttccgtccttacctatggagctaaatcttgcccacaaacttcaaacaaaaatcagcaatatga

SEQ ID NO: 204828 - DNA, 1954 bp, Homo sapiens
  Payload ID: 20401
  Gene Name: zona pellucida glycoprotein 1 (sperm receptor)
  Uniprot ID: P60852
  ENST ID: ENST00000278853
  CDS Start-End: 1-1917
atggcaggaggctcagccacgacctggggttaccctgtggccctgctactgctggttgccaccctggggctgggtaggtggctccagcccgaccctggcctcccaggcctccggcacagctacgactgtgggatcaagggaatgcagctgctggtgttccccaggccaggccagactctccgcttcaaggtggtggatgaatttgggaaccgatttgatgtcaacaactgctccatctgctaccactgggtcacctccaggccgcaggagcctgcagtcttctcggccgattacagaggctgccacgtgctggagaaggatgggcgtttccacctgagggtgttcatggaggctgtgctgcccaatggtcgtgtggatgtggcacaagacgctactctgatctgtcccaaacctgacccctcccggactctggactcccagctggcaccacccgccatgttctctgtctcaaccccacaaaccctttccttcctccccacctctggccatacctcccaaggctctggccatgcctttcccagcccactggacccagggcacagctctgtccacccaacccctgctttaccatcccctggacctggacctaccctcgccaccctggctcaaccccactggggcaccttggaacactgggatgtgaacaaacgagattacataggtacccacctgagccaggagcagtgccaggtggcctcagggcacctcccctgcatcgtgagaagaacttcaaaagaagcctgtcagcaggctggctgctgctatgacaacaccagagaggttccctgttactatggcaacacagctactgtccagtgcttcagagatggctacttcgtcctcgtggtgtcccaagaaatggccttgacacacaggatcacactggccaacatccacctggcctatgcccccaccagctgctccccaacacagcacacggaagctttcgtggtcttctacttccctctcacccactgtggaaccacaatgcaggtggctggcgaccagctcatctatgagaactggctggtgtctggcatccacatccaaaaggggccacagggttccatcacgcgggacagcaccttccagcttcatgtgcgctgtgtcttcaacgccagtgacttcctgcccattcaggcatccattttcccacccccatcgcctgctcctatgacccagcccggccccctgcggcttgagctgcggattgccaaagacgagaccttcagctcgtactatggggaggatgactatcccatcgtgaggctgctccgagaaccagtccatgtggaggtccggcttctgcagaggacagaccccaacctggtcctgctgctgcaccagtgctggggcgctcccagtgccaaccccttccagcagccccagtggcccatcctgtcagacggatgccctttcaagggcgacagctacagaacccaaatggtagccttggacggggccacacctttccagtcgcactaccagcgattcactgttgctaccttcgccctcctggactcaggctcccagagagccctcagaggactggtttacttgttctgcagcacctctgcctgccacacctcagggctggagacttgctccactgcatgtagcactggcactacaagacagcgacgatcctcaggtcaccgtaatgacactgccaggccccaggacatcgtgagctctccggggccagtgggctttgaggattcttatgggcaggagcccacacttgggcccacagactccaatgggaactccagcctgagacctctcctttgggcggtccttttgctgccagctgttgccctggtccttgggtttggtgtctttgtgggcctgagccagacctgggcccagaagctctgggaaagcaacagacagtgaatgggcccaataaacaatcatttcaaacctactgaaa

SEQ ID NO: 204829 - DNA, 418 bp, Homo sapiens
  Payload ID: 20401
  Gene Name: zona pellucida glycoprotein 1 (sperm receptor)
  ENST ID: ENST00000540908
  CDS Start-End: 1-122
accgatttgatgtcaacaactgctccatctgctaccactgggtcacctccaggccgcaggagcctgcagtcttctcggccgattacagaggctgccacgtgctggagaaggtacccacctgagccaggagcagtgccaggtggcctcagggcacctcccctgcatcgtgagaagaacttcaaaagaagcctgtcagcaggctggctgctgctatgacaacaccagagaggttccctgttactatggcaacacagctactgtccagtgcttcagagatggctacttcgtcctcgtggtgtcccaagaaatggccttgacacacaggatcacactggccaacatccacctggcctatgcccccaccagctgctccccaacacagcacacggaagctttcgtggtcttctacttccctctc

SEQ ID NO: 204830 - DNA, 1569 bp, Homo sapiens
  Payload ID: 20401
  Gene Name: zona pellucida glycoprotein 1 (sperm receptor)
  ENST ID: ENST00000620319
  CDS Start-End: 499-1491
ggattctgaagcggaaggagagctgtctcctccagctggtggaaactgcttcctatcctcctcctggagagcccaactcccagagcagatggcagaggagacctttagatggggcggtcacatgtcccagctggccttataacaactgtcccagggaactattaatagatctaccttacacacatctggactttcagatctgaaacgccctggtttggatgacagattatatggtgaacctacttttagagtgtagttcaactcatttgtcacatggatgagaaaatcagtccataaagggtttgctggggccaacaccagcctaagtggagagtaagcgtccattctcctagaccggcacttaaagcctggctgtcacccagccatcccgtctctgtgctggatggacaccaaaccccaaggccctcatctgcctttgtcccagctactgtccagtgcttcagagatggctacttcgtcctcgtggtgtcccaagaaatggccttgacacacaggatcacactggccaacatccacctggcctatgcccccaccagctgctccccaacacagcacacggaagctttcgtggtcttctacttccctctcacccactgtggaaccacaatgcaggtggctggcgaccagctcatctatgagaactggctggtgtctggcatccacatccaaaaggggccacagggttccatcacgcgggacagcaccttccagcttcatgtgcgctgtgtcttcaacgccagtgacttcctgcccattcaggcatccattttcccacccccatcgcctgctcctatgacccagcccggccccctgcggcttgagctgcggattgccaaagacgagaccttcagctcgtactatggggaggatgactatcccatcgtgaggctgctccgagaaccagtccatgtggaggtccggcttctgcagaggacagaccccaacctggtcctgctgctgcaccagtgctggggcgctcccagtgccaaccccttccagcagccccagtggcccatcctgtcagacggatgccctttcaagggcgacagctacagaacccaaatggtagccttggacggggccacacctttccagtcgcactaccagcgattcactgttgctaccttcgccctcctggactcaggctcccagagagccctcagaggactggtttacttgttctgcagcacctctgcctgccacacctcagggctggagacttgctccactgcatgtagcactggcactacaagacagcgacgatcctcaggtcaccgtaatgacactgccaggccccaggacatcgtgagctctccggggccagtgggctttgaggattcttatgggcaggagcccacacttgggcccacagactccaatgggaactccagcctgagacctctcctttgggcggtccttttgctgccagctgttgccctggtccttgggtttggtgtctttgtggcctgagccagacctgggcccagaagctctgggaaagcaacagacagtgaatgggcccaataaacaatcatttcaaacctactg

SEQ ID NO: 204831 - DNA, 2241 bp, Homo sapiens
  Payload ID: 20402
  Gene Name: zona pellucida glycoprotein 2 (sperm receptor)
  Uniprot ID: Q05996
  ENST ID: ENST00000574091
  CDS Start-End: 1-2211
atggcgtgcaggcagagaggaggctcttggagtccctcaggctggttcaatgcaggctggagcacctacaggtcgatttctctcttcttcgcccttgtgacttcagggaactccatagatgtttctcagttggtaaatcctgcctttccaggcactgtcacttgcgatgaaagggaaataacagtggagttcccaagcagtcctggcaccaagaaatggcatgcatctgtggtggatcctcttggtctcgacatgccgaactgcacttacatcctggacccagaaaagctcaccctgagggctacctatgataactgtaccaggagagtgcatggtggacaccagatgaccatcagagtcatgaacaacagtgctgccttaagacacggagctgtcatgtatcagttcttctgtccagctatgcaagtagaagagacccaggggctttcagcatctacaatctgccagaaggatttcatgtctttttccttgccacgggtcttctctggcttggctgacgacagtaaggggaccaaagttcagatgggatggagcattgaggttggtgatggtgcaagagccaaaactctgaccctgccagaggccatgaaggaaggcttcagcctcttgattgacaaccacaggatgaccttccatgtgccattcaatgccactggagtgactcactatgtgcaaggtaacagtcatctctacatggtgtctctgaagcttacatttatatctcctggacagaaggtgatcttctcttcacaagctatttgtgcaccagatcctgtgacctgcaatgccacacacatgactctcaccataccagagtttcctgggaagcttaagtctgtgagctttgaaaaccagaacattgatgtgagccagctgcatgacaatggaattgatctagaagcaacaaatggcatgaaattgcatttcagcaaaactctgctcaaaacgaaattatctgaaaaatgcctactccatcagttctacttagcttcactcaagctgacctttctccttcggccagagacagtatccatggtgatctatcctgagtgtctctgtgagtcacccgtttctatagttacaggggagctgtgcacccaggatgggtttatggacgtcgaggtctacagctaccaaacacaaccagctcttgacctgggtactctgagggtgggaaactcatcctgccagcctgtctttgaggctcagtctcaggggctggtacggttccacatacccctgaatggatgtggaacgagatataagttcgaagatgataaagtcgtctatgaaaacgaaatacatgctctctggacggattttcctccaagcaaaatatctagagacagtgagttcaggaatgacatgctactaaacatcaacgttgaaagccttactcctccagtggcctcagtgaagttgggtccatttaccttgatcctgcaaagctacccagataattcctaccaacaaccttatggggaaaacgagtaccctctagtgagattcctccgccaaccaatttacatggaagtgagagtcctaaacagggatgaccccaacatcaagctggtcttagatgactgctgggcgacgtccaccatggatccagactctttcccccagtggaacgttgtcgtggatggctgtgcatatgacctggacaactaccagaccaccttccatccagtcggctcctctgtgacccatcctgatcactatcagaggtttgacatgaaggcttttgcctttgtatcagaagcccacgtgctctctagcctggtctacttccactgcagtgccttaatctgtaatcgactctcccctgactccccactgtgttctgtgacctgccctgtgtcctctaggcacaggcgagccacaggggccactgaagcagagaaaatgacagtcagcctcccaggacccattctcctgttgtcagatgactcctcattcagaggtgtcggctcatctgatctaaaagcaagtgggagcagtggggagaagagtaggagtgaaacaggggaggaggttggctcacgaggtgctatggacaccaaagggcacaagactgctggagatgttggttccaaagctgtggctgctgtggctgcctttgcaggtgtggtggcaactctaggcttcatctactacctgtacgagaaaaggactgtgtcaaatcactaaatgggcttctaaataaagcagtcaaaataa

SEQ ID NO: 204832 - DNA, 2749 bp, Homo sapiens
  Payload ID: 20402
  Gene Name: zona pellucida glycoprotein 2 (sperm receptor)
  Uniprot ID: Q05996
  ENST ID: ENST00000574002
  CDS Start-End: 484-2721
gtgtgatgttcccctccctgtgtccatgtgttctcattgttcagctcccacttataagtgagaacagaatgttaagaatcatttttgtaataactttagtttttcctacctcctgataggagacactgttttacggagcagctatttcttcctgtgttcaaagtcagttgctgaacagatggtagcttcctgcttttccggagcagaatcctagacatggatgctcctgggcccagagccatttgttcggtggctgtccccagcacaccacaggtctgggttagggcagctggcagaatacccggcgcaagctgtcaggaatcagaggccacttccttccccaatccttccgtttcagctgggagaatgggacaagattcaggtgcccccaatggggagagggtgtggatgcggctggcttcctgctataaaaacacagagcagcctaccctctacctggttgatctggtagtgtcttctgctatggcgtgcaggcagagaggaggctcttggagtccctcaggctggttcaatgcaggctggagcacctacaggtcgatttctctcttcttcgcccttgtgacttcagggaactccatagatgtttctcagttggtaaatcctgcctttccaggcactgtcacttgcgatgaaagggaaataacagtggagttcccaagcagtcctggcaccaagaaatggcatgcatctgtggtggatcctcttggtctcgacatgccgaactgcacttacatcctggacccagaaaagctcaccctgagggctacctatgataactgtaccaggagagtgcatggtggacaccagatgaccatcagagtcatgaacaacagtgctgccttaagacacggagctgtcatgtatcagttcttctgtccagctatgcaagtagaagagacccaggggctttcagcatctacaatctgccagaaggatttcatgtctttttccttgccacgggtcttctctggcttggctgacgacagtaaggggaccaaagttcagatgggatggagcattgaggttggtgatggtgcaagagccaaaactctgaccctgccagaggccatgaaggaaggcttcagcctcttgattgacaaccacaggatgaccttccatgtgccattcaatgccactggagtgactcactatgtgcaaggtaacagtcatctctacatggtgtctctgaagcttacatttatatctcctggacagaaggtgatcttctcttcacaagctatttgtgcaccagatcctgtgacctgcaatgccacacacatgactctcaccataccagagtttcctgggaagcttaagtctgtgagctttgaaaaccagaacattgatgtgagccagctgcatgacaatggaattgatctagaagcaacaaatggcatgaaattgcatttcagcaaaactctgctcaaaacgaaattatctgaaaaatgcctactccatcagttctacttagcttcactcaagctgacctttctccttcggccagagacagtatccatggtgatctatcctgagtgtctctgtgagtcacccgtttctatagttacaggggagctgtgcacccaggatgggtttatggacgtcgaggtctacagctaccaaacacaaccagctcttgacctgggtactctgagggtgggaaactcatcctgccagcctgtctttgaggctcagtctcaggggctggtacggttccacatacccctgaatggatgtggaacgagatataagttcgaagatgataaagtcgtctatgaaaacgaaatacatgctctctggacggattttcctccaagcaaaatatctagagacagtgagttcagaatgacagtgaagtgttcttatagcaggaatgacatgctactaaacatcaacgttgaaagccttactcctccagtggcctcagtgaagttgggtccatttaccttgatcctgcaaagctacccagataattcctaccaacaaccttatggggaaaacgagtaccctctagtgagattcctccgccaaccaatttacatggaagtgagagtcctaaacagggatgaccccaacatcaagctggtcttagatgactgctgggcgacgtccaccatggatccagactctttcccccagtggaacgttgtcgtggatggctgtgcatatgacctggacaactaccagaccaccttccatccagtcggctcctctgtgacccatcctgatcactatcagaggtttgacatgaaggcttttgcctttgtatcagaagcccacgtgctctctagcctggtctacttccactgcagtgccttaatctgtaatcgactctcccctgactccccactgtgttctgtgacctgccctgtgtcctctaggcacaggcgagccacaggggccactgaagcagagaaaatgacagtcagcctcccaggacccattctcctgttgtcagatgactcctcattcagaggtgtcggctcatctgatctaaaagcaagtgggagcagtggggagaagagtaggagtgaaacaggggaggaggttggctcacgaggtgctatggacaccaaagggcacaagactgctggagatgttggttccaaagctgtggctgctgtggctgcctttgcaggtgtggtggcaactctaggcttcatctactacctgtacgagaaaaggactgtgtcaaatcactaaatgggcttctaaataaagcagtcaaaat

SEQ ID NO: 204833 - DNA, 1483 bp, Homo sapiens
  Payload ID: 20403
  Gene Name: zona pellucida glycoprotein 3 (sperm receptor)
  Uniprot ID: P21754
  ENST ID: ENST00000336517
  CDS Start-End: 347-1468
ctgcgcagagcgcgcccgcgtcctcgtggtggccgcagttgtgcacaccccagcccaggctctggcaggctgccaggcggggctcgccgccttcgcagtgcacgttgtccagcaggatgtgtccggtgccatagccgaagaaggcgttggtggtggcggccatggccgccccgcagcccagctgacgacagaccacagcggcatccggcagcccccagtcgtcgtcacacacggtgccccacaggccactgtgcaggatctccactcggccctgacacagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggtaactgacgatgccctggtgtacagcaccttcctgctccatgacccccgccccgtgggaaacctgtccatcgtgaggactaaccgcgcagagattcccatcgagtgccgctaccccaggcagggcaatgtgagcagccaggccatcctgcccacctggttgcccttcaggaccacggtgttctcagaggagaagctgactttctctctgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaagcaata

SEQ ID NO: 204834 - DNA, 1348 bp, Homo sapiens
  Payload ID: 20403
  Gene Name: zona pellucida glycoprotein 3 (sperm receptor)
  Uniprot ID: P21754
  ENST ID: ENST00000394857
  CDS Start-End: 59-1333
ccagcatcccacgggtataagatggccagaggcggctgcctgctgctctgcaggtaccatggagctgagctataggctcttcatctgcctcctgctctggggtagtactgagctgtgctacccccaacccctctggctcttgcagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggtaactgacgatgccctggtgtacagcaccttcctgctccatgacccccgccccgtgggaaacctgtccatcgtgaggactaaccgcgcagagattcccatcgagtgccgctaccccaggcagggcaatgtgagcagccaggccatcctgcccacctggttgcccttcaggaccacggtgttctcagaggagaagctgactttctctctgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaagcaata

SEQ ID NO: 204835 - DNA, 783 bp, Homo sapiens
  Payload ID: 20403
  Gene Name: zona pellucida glycoprotein 3 (sperm receptor)
  ENST ID: ENST00000394860
  CDS Start-End: 1-776
agaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacaggcaacaaaaatctaagctgcttctctttcatctcagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaaga

SEQ ID NO: 204836 - DNA, 1846 bp, Homo sapiens
  Payload ID: 20403
  Gene Name: zona pellucida glycoprotein 3 (sperm receptor)
  ENST ID: ENST00000416245
  CDS Start-End: 1094-1840
gaaatgggcttgaataggttagaagctgatgtgggttgttgtgttttttgtttgtttttgtttttgagagttttgctcttgttgcccaggctagaatgcaatggcacgatctccgctcactgcaacctctgcctcccgggttcaagcgattcttctgcctcagtctcccgagtagctgggattacaggcacgtgccaccacactcagctaattttttttttttaagtagagatggggtttcaccatgttggtcaggctggtctcaaactcctgacctcagatgatctgccctcctcagcctcccaaagtgctgggattacgggcgtgagccacagcgcccagccagaagctgataagtgttaacagctgggcacttcctgactgcttcctggcggctatcttggccctgggcctctcctgaaagaggaaactgtatgtactggggggcatggagggggagtgtcagaagggatgtgtcatgtgccctgatgcctctattgcttgggtgttacatggtatctgccatgtggttgatccagtctgcctgtggtggtgtcaatatgtggtgtcaggtaaagattccgaggtacaaagacagtacctgtcctgcctctttcctgaccagtggcagagcctgtgttctcttttgtagagatggggtcttgctatgtttcccaggccagtctcaaactcctggcctcaagcaatccttggcctcccaaagtgctggggttacaggcatgagtcactgcacctggccttgaccctgtggtctttctgtccccttgtgggctgccctccctgagcactcaggtatggcttgggagtacccgggcaggtgatggccggcagcattaacttctcacctttcctccaggtaactgacgatgccctggtgtacagcaccttcctgctccatgacccccgccccgtgggaaacctgtccatcgtgaggactaaccgcgcagagattcccatcgagtgccgctaccccaggcagggcaatgtgagcagccaggccatcctgcccacctggttgcccttcaggaccacggtgttctcagaggagaagctgactttctctctgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaag

SEQ ID NO: 204837 - DNA, 1799 bp, Homo sapiens
  Payload ID: 20404
  Gene Name: zona pellucida glycoprotein 4
  Uniprot ID: Q12836
  ENST ID: ENST00000366570
  CDS Start-End: 160-1782
gaattcccctttctgaaggcatcccacctgagtgtcacaaagatgtgcagctgaaaacaagcctgacttctgtatataaaggaatctgggcaggcagaccctcggctcttgggagaggaggcggagagtctgcagccggcaggaactcctggtagcattatgtggctgctgcggtgcgttttgctgtgtgtttcattatctcttgctgtgagtggccagcataagcctgaggcaccagattattccagtgtgctccactgtgggccgtggagcttccagtttgctgtaaacctcaaccaggaggcaacgtctcctcctgtactaatagcttgggacaaccaagggctgctgcacgagctgcagaatgactccgactgtggcacctggataagaaaaggtccaggcagctccgtggtgttggaggcaacctatagcagctgctatgtcactgagtgggactcccactacatcatgccagttggagttgaaggagcaggcgcggctgaacacaaggtggttacagagaggaagctgctcaagtgtcctatggatcttctagcccgagatgctccagatactgactggtgtgactccatcccagcacgggacagactgccatgtgcaccttcacccatctctcgaggagactgtgaagggctaggctgttgttatagctctgaagaggtgaattcctgctactatggaaacactgtgaccttgcattgtacccgagagggccatttctctattgctgtgtctcggaacgtgacctcgccaccactgctcttggattctgtgcgcttggcccttaggaatgacagtgcgtgtaaccctgtgatggcaacacaagcttttgttctgttccagtttccatttacttcctgtggcaccacaagacagatcactggagaccgagcagtatatgaaaatgaactggtggcaactagggatgtgaaaaatgggagccgtggctctgtcactcgtgacagcatcttcaggctccatgtcagctgcagctactcagtaagtagcaactctctcccaatcaatgtccaggttttcactctcccaccaccctttcctgagacccagcctggacccctcactctggaacttcagattgccaaagataaaaactatggctcttactacggtgttggtgactacccagtggtgaagttgcttcgggatcccatttacgtggaggtctccatccttcacagaacagacccctacctggggctgctcctacaacagtgttgggcaacacccagcactgaccccctgagtcagccacagtggcccatcctggtaaagggctgcccctacattggagacaactatcagacccagctgatccctgtccagaaagccttggatcttccatttccctctcaccaccagcgcttcagcatcttcaccttcagctttgtgaaccctacagtggagaaacaggccctcaggggaccggtgcatctgcactgcagcgtgtcagtctgccagcctgctgagacaccatcctgtgtggtgacctgtcctgatctcagtcgaagaagaaattttgacaacagttctcagaacactactgctagtgtttctagcaaaggccccatgattctactccaagccactaaggaccctccagaaaagctccgtgttcctgtagactcgaaagttctgtgggtggcaggcctttctgggaccttaatccttggagccttgttagtatcctacttggctgtcaagaaacagaagagttgcccagaccaaatgtgtcaataaaaccagagtgtattccc

SEQ ID NO: 204838 - DNA, 2474 bp, Homo sapiens
  Payload ID: 20404
  Gene Name: zona pellucida glycoprotein 4
  Uniprot ID: Q12836
  ENST ID: ENST00000611898
  CDS Start-End: 288-1910
agctttctttccttcctttctgttagctaaaagttactacatttttcttgggctctgaagtctgcctggattgtggtatttaatgtgaggcagctgcagactgtgccccaaagcaaatgaggctagaggaattcccctttctgaaggcatcccacctgagtgtcacaaagatgtgcagctgaaaacaagcctgacttctgtatataaaggaatctgggcaggcagaccctcggctcttgggagaggaggcggagagtctgcagccggcaggaactcctggtagcattatgtggctgctgcggtgcgttttgctgtgtgtttcattatctcttgctgtgagtggccagcataagcctgaggcaccagattattccagtgtgctccactgtgggccgtggagcttccagtttgctgtaaacctcaaccaggaggcaacgtctcctcctgtactaatagcttgggacaaccaagggctgctgcacgagctgcagaatgactccgactgtggcacctggataagaaaaggtccaggcagctccgtggtgttggaggcaacctatagcagctgctatgtcactgagtgggactcccactacatcatgccagttggagttgaaggagcaggcgcggctgaacacaaggtggttacagagaggaagctgctcaagtgtcctatggatcttctagcccgagatgctccagatactgactggtgtgactccatcccagcacgggacagactgccatgtgcaccttcacccatctctcgaggagactgtgaagggctaggctgttgttatagctctgaagaggtgaattcctgctactatggaaacactgtgaccttgcattgtacccgagagggccatttctctattgctgtgtctcggaacgtgacctcgccaccactgctcttggattctgtgcgcttggcccttaggaatgacagtgcgtgtaaccctgtgatggcaacacaagcttttgttctgttccagtttccatttacttcctgtggcaccacaagacagatcactggagaccgagcagtatatgaaaatgaactggtggcaactagggatgtgaaaaatgggagccgtggctctgtcactcgtgacagcatcttcaggctccatgtcagctgcagctactcagtaagtagcaactctctcccaatcaatgtccaggttttcactctcccaccaccctttcctgagacccagcctggacccctcactctggaacttcagattgccaaagataaaaactatggctcttactacggtgttggtgactacccagtggtgaagttgcttcgggatcccatttacgtggaggtctccatccttcacagaacagacccctacctggggctgctcctacaacagtgttgggcaacacccagcactgaccccctgagtcagccacagtggcccatcctggtaaagggctgcccctacattggagacaactatcagacccagctgatccctgtccagaaagccttggatcttccatttccctctcaccaccagcgcttcagcatcttcaccttcagctttgtgaaccctacagtggagaaacaggccctcaggggaccggtgcatctgcactgcagcgtgtcagtctgccagcctgctgagacaccatcctgtgtggtgacctgtcctgatctcagtcgaagaagaaattttgacaacagttctcagaacactactgctagtgtttctagcaaaggccccatgattctactccaagccactaaggaccctccagaaaagctccgtgttcctgtagactcgaaagttctgtgggtggcaggcctttctgggaccttaatccttggagccttgttagtatcctacttggctgtcaagaaacagaagagttgcccagaccaaatgtgtcaataaaaccagagtgtattcccagcctgtgctgagcttctcatttgaaagggaaatatttatcttggcttcttggaagtctaacctgagaacctaaggaagctggcaggtgactggaaacagcatcttgactttaccctccatgtattgaaacattttattggatccttattttggacaaagttcccttttatattaggaaatgaagtcagtactctggtccaacaaccaacaacatggaacttgtttacatggtctggtaacaagaataatggtaggaaaccagaagttgaagctgatgttatagcagccgtttggaaagaagcctattctaacaatgtcacgttccctgccactcccatcttcactcagaatattcagatcagaagagccagatacagacacagagatgtaatctctgtgaactcaactttctcacctctgaaatagaaaactatcaattgtttctagctgtctggctctaaatttttggttcttagaaccttcttaatccccttcagtttttttccacgggtcttgatttgcagctgtcctttggaaactctactc

SEQ ID NO: 204839 - DNA, 3619 bp, Homo sapiens
  Payload ID: 20405
  Gene Name: zona pellucida-like domain containing 1
  Uniprot ID: Q8TCW7
  ENST ID: ENST00000306176
  CDS Start-End: 101-1396
taaagggtgttaacataatcccccaatcccatacaattcaatttcagaaaagtatttagggactgtgctaaaatagcatctccaagcttgctatggcaagatgatgctcaggttttccatgtgcaggggaaatgatgaaggttttgcaatggaacaaatatggttgctgctgcttctaacaattagagtgcttccggggtctgctcagttcaacggctacaactgtgatgccaacctccacagtagatttcctgctgaaagagacatcagtgtctattgtggagtgcaggctattacgatgaagattaatttttgcacggtacttttctcgggttattcggaaacagatctggcactgaatggaaggcatggggactcccactgcagagggttcatcaataacaacacctttccagcagtggtcatttttatcatcaatctcagcaccttggagggctgtggaaacaacctggtggtatccacaattcctggagtcagtgcttatggaaatgcaacttcagtgcaagtaggaaatatttcaggatatattgatactccagacccaccaacaatcatcagctatctacctgggcttctttacaaatttagttgtagttatccattggaatacctggttaataatacccagcttgcttcgtcctcagcggctatttctgtgagagagaacaatggcacatttgtcagcactttgaacctgctcctttataacgattcaacctacaaccagcagttaattatccccagtataggattacctttgaaaaccaaagtatttgcagctgtccaagccactaatttggatggcagatggaatgttttaatggattattgctatactaccccatcaggaaacccaaatgatgacattcgatatgatcttttccttagctgtgacaaggaccctcagaccaccgtcattgagaatggccgaagccagcggggccggttttcttttgaagtgttccgatttgtgaaacacaagaatcagaaaatgtccactgtcttcttgcactgcgttaccaagctctgcagagcagatgactgccccttccttatgccgatttgcagccacagagaaaggagagatgctgggaggaggacgacttggagcccccagagctcttctggcagcgcggtgctctctgctggtcccatcattactcggagtgatgagactccaaccaacaattcgcaacttggttctccaagtatgcctcccttccagctgaacgccatcaccagcgcactgatatcaggaatggtcattctgggagttacgagcttttctcttcttctgtgctcactggcccttctgcacaggaagggacccacaagtttagtgttgaatggcataagaaacccagtctttgactgactataacagattcctgctctctggagaaggcttcactgactaaactatgtgtgactgcagtcagtgttccgtctgaatttcatgtcagtccacattcaatatttgtaggtttgataaatttcacagtatagcttgtcagcataatgatagtgaaagaagtttattatattgctattgtcacttatgtacgtggcgagccgtatttttatgccaccagtgaatatattgacaataagtgaaaaatattcaggacttagggcttacaggatcagtaatatttcattttatttcagttttcttttgattgttggttaaaagataaaaggtgggagtagacaaaaaatgaaatgtgttgcatttcccccttaagcattaatggcatttagatttgcacacgtggtcctagaataaatgttgctttttgttttaatccggatattcccagcttcaggatgtgttttaataggactggccaatttggatacctgagatttaactactcattctatgacctcctgtgtttttggccgattttcatgtctgaccatattcattttaaaagaaactcttgggacatatctcttaacctggggcacccttttgtgtagaagatagtgaaaatagttgttagcttccaaggctactgctaagtggccctagatcattattcattagaataggaatggctgcgatcagttttcttcttctggttcaggtgagaacaccagcacatgttaactctcctcccaggtaaacagttcagctgctgttgcagctgtgcttccagcagtgaggtaactatgcaaagattatttttaattcaagaatcatcacatgtgaaaacaagctgtagttgtgaaaagagttcctagaagggtttttaacaatttagattccctttttcctaaaacaaaaaggaaacttaggttaagtgtagtttgcagaacattgttggaatctacataaaaagatattccttcccccatattttcgatgccaggcaataatcaggagagggtttctttttaaggtatcttcttgtaggtgtcataattgccatgaataaacaatattttcctctaacagtaaactgcaagaagcttctgatcctttatcagttttgcaaaaaagcaagctttaagcagcccatgttcttacaaaaaaaatcaacattctctttgtttaagctacctatgcactgaacaaacaaaacaatttaatagccaacaccaaaacccagcatgtgaagttactagaattgccatgttaactataagcaattgctgtaatcactaatttctattcaacatttgtgacccattagtccggacttaatttactatactgcatgcaaatcatcaagcaattgcttcaaaggaaatgtctacaatgtgagttaataattaaatcaatcctcaagttgaaaaacactttttctccaatttgcctgaatatttcaggaggaagtgtttatattataataattagctatataattgcatcaactttttatttcaaggtatagttgccaagtaaagtgggatctggaaagtctctggataatttctttacaaaaaaagtttaaatcacataaaaagccaatctactcttccctgtgttactttaaaataactttgaagtgactattctgagctttatctgtgttaacatgattaactgaccatactactaatgtgaccctgtatatacatggatagtattgaaatatgctggtaaatctatttcagatactttaagtgaattgccattgattctacgattaagttctgtgaataggacattatatcatttaagctgttttgtcaatttgatttttatgcttttggaacggctgctgtttcagctgttggccttttcaattctatactccattttatagaattgaataatggacacatgtcacttgggaagcaacgtaagtatcacattattttttgccaccctttcatcataaatggaagaatcagagttataatgagataaaccaggtctgttttttacaactttgttcttataaatctgcagttatatggagtatttagttatactgaattttacagttattatagtgtgaaaaaccttacaaaatatgtgcaaatgtttcttcagttttaatacctcaaactgttttttgcacttcaggggtaaggtctgatgacatgtaaaagatgatcgtttaataaaataattgtttaaaatgtt

SEQ ID NO: 204840 - DNA, 1531 bp, Homo sapiens
  Payload ID: 20405
  Gene Name: zona pellucida-like domain containing 1
  Uniprot ID: Q8TCW7
  ENST ID: ENST00000466937
  CDS Start-End: 245-1492
tcccccaatcccatacaattcaatttcagaaaagtatttagggactgtgctaaaatagcatctccaagcttgctatggcaagatgatgctcaggttttccatgtgcaggggaaatgatgaaggatacacctctgtgttggggacaacagtgtgggtctagagtttccaatgtcttccaggagttcttgggacccatcatgagaaggaagtggtggagcatggagcatggaataaatgttttgcaatggaacaaatatggttgctgctgcttctaacaattagagtgcttccggggtctgctcagttcaacggctacaactgtgatgccaacctccacagtagatttcctgctgaaagagacatcagtgtctattgtggagtgcaggctattacgatgaagattaatttttgcacggtacttttctcgggttattcggaaacagatctggcactgaatggaaggcatggggactcccactgcagagggttcatcaataacaacacctttccagcagtggtcatttttatcatcaatctcagcaccttggagggctgtggaaacaacctggtggtatccacaattcctggagtcagtgcttatggaaatgcaacttcagtgcaagtaggaaatatttcaggatatattgatactccagacccaccaacaatcatcagctatctacctgggcttctttacaaatttagttgtagttatccattggaatacctggttaataatacccagcttgcttcgtcctcagcggctatttctgtgagagagaacaatggcacatttgtcagcactttgaacctgctcctttataacgattcaacctacaaccagcagttaattatccccagtataggattacctttgaaaaccaaagtatttgcagctgtccaagccactaatttggatggcagatggaatgttttaatggattattgctatactaccccatcaggaaacccaaatgatgacattcgatatgatcttttccttagctgtgacaaggaccctcagaccaccgtcattgagaatggccgaagccagcggggccggttttcttttgaagtgttccgatttgtgaaacacaagaatcagaaaatgtccactgtcttcttgcactgcgttaccaagctctgcagagcagatgactgccccttccttatgccgatttgcagccacagagaaaggagagatgctgggaggaggacgacttggagcccccagagctcttctggcagcgcggtgctctctgctggtcccatcattactcggagtgatgagactccaaccaacaattcgcaacttggttctccaagtatgcctcccttccagctgaacgccatcaccagcgcactgatatcaggaatggtcattctgggagttacgagcttttctcttcttctgtgctcactggcccttctgcacaggaagggacccacaagtttagtgttgaatggcataagaaacccagtctttgactgactataacagattcctgctctctggagaaggcttcactga

SEQ ID NO: 204841 - DNA, 2189 bp, Homo sapiens
  Payload ID: 20405
  Gene Name: zona pellucida-like domain containing 1
  Uniprot ID: Q8TCW7
  ENST ID: ENST00000491959
  CDS Start-End: 883-2130
agtatgtataaagtgcttagaagagggcctggaacataggacatggatgaagctggaaaccatcattctcagcagactaacacaggaacagaaaaccaaacaccagtgttccagatttgcattaagctgtcacccggtggctgtgtaactagctgcttttgtgactgttacagccgcaaaagccttaacagacctgcagttacagactcagggaaaagcttgtactgttgtttgtggatcgcagggaagccagagttgcagctgactttctgtccacgagatggcggtagaggagcacagaaaaaagaaaccatcttgggctgttaatcatgttgactgttgagaagctaagagggaagccgatctgtcattagggtgaaaaaaaaagtcactgtaacaggagtcaagaaggggcttagaacctagtcatgtgaatattttcaagtttttcttgccttgtgttttttcatcaaatgaggttcagtgaattcgggactcagtaactccattagtgactgcacccacatagacctttttctaaaagtctccacatttgtccagttgtttcctccttggtccaatgccaacgctccgtcaatgctattgccacccccattctgcctcttccaaaagcctgcatcagtcatggagtcctcttcacctgaaataagcacttagtataaaccgatgcaactggttttgtgctggaagacaagcttagcaacgacatttcaaaaagagcagctcttctctcatttgaagccttgactcttttctgaaaaagtttggtaaggtcaggcatttgaacactcagtcacatgcggcagaacctagcacatggaggacagctgactccacagaaccagggatttgggttttgcaatggaacaaatatggttgctgctgcttctaacaattagagtgcttccggggtctgctcagttcaacggctacaactgtgatgccaacctccacagtagatttcctgctgaaagagacatcagtgtctattgtggagtgcaggctattacgatgaagattaatttttgcacggtacttttctcgggttattcggaaacagatctggcactgaatggaaggcatggggactcccactgcagagggttcatcaataacaacacctttccagcagtggtcatttttatcatcaatctcagcaccttggagggctgtggaaacaacctggtggtatccacaattcctggagtcagtgcttatggaaatgcaacttcagtgcaagtaggaaatatttcaggatatattgatactccagacccaccaacaatcatcagctatctacctgggcttctttacaaatttagttgtagttatccattggaatacctggttaataatacccagcttgcttcgtcctcagcggctatttctgtgagagagaacaatggcacatttgtcagcactttgaacctgctcctttataacgattcaacctacaaccagcagttaattatccccagtataggattacctttgaaaaccaaagtatttgcagctgtccaagccactaatttggatggcagatggaatgttttaatggattattgctatactaccccatcaggaaacccaaatgatgacattcgatatgatcttttccttagctgtgacaaggaccctcagaccaccgtcattgagaatggccgaagccagcggggccggttttcttttgaagtgttccgatttgtgaaacacaagaatcagaaaatgtccactgtcttcttgcactgcgttaccaagctctgcagagcagatgactgccccttccttatgccgatttgcagccacagagaaaggagagatgctgggaggaggacgacttggagcccccagagctcttctggcagcgcggtgctctctgctggtcccatcattactcggagtgatgagactccaaccaacaattcgcaacttggttctccaagtatgcctcccttccagctgaacgccatcaccagcgcactgatatcaggaatggtcattctgggagttacgagcttttctcttcttctgtgctcactggcccttctgcacaggaagggacccacaagtttagtgttgaatggcataagaaacccagtctttgactgactataacagattcctgctctctggagaaggcttcactgactaaactatgtgtgactgca

SEQ ID NO: 204842 - DNA, 8470 bp, Homo sapiens
  Payload ID: 20406
  Gene Name: zonadhesin (gene/pseudogene)
  ENST ID: ENST00000546213
  CDS Start-End: 166-7971
gccatgttgatttctgatccttgagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggaaagagaagcctccggaccagaagctggttgttcgcagctctagggacaactatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccggctgatgtttgagggaacacggggtagcactgcctacctggacatcgccctggatgccctctctatccgccggggctcctgtaatcgcgtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttggggagtatccggaaacacactctcttctcaggacaacctgggcccaactggcaggctgtttctgtcaattacacagccgtgggacggatacagtttgccgtggtaggcgtttttggaaagaccccagagccagctgtggcagttgatgcaaccagcattgctccttgtggggagggttttcctcagtgtgactttgaagacaacgcccatcccttctgtgactgggtccagacttccggggatggtggacactgggccctcggacataaaaatggacccgtccatggcatgggccctgcgggaggtttccctaatgcagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcagcttattttcaagggcatccagggaagcaacacggcctctgtggttgctatgggtttcatcttgatcaatcctgggacttgtccagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgagcctggggcagagtggttcagccccaactgcacagaacattgccgctgctggcccggcagtcgggtcgagtgccagatctctcagtgtgggacacacaccgtgtgccagcttaagaatggccagtatggatgccacccctacgcaggcactgccacctgcttggtctacggagaccctcattatgtcacctttgacgggaggcactttggcttcatgggcaagtgcacttacatcttggcccagccctgtggcaactcaacagacccattcttcagggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtcggggagcgctggtacacagagaacacctgcaccaggctctgcacctgctccgtccacaacaacatcacctgcttccagagcacctgcaaacccaaccagatatgctgggccctggatgggctgctccattgtcgggcctcaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtctgcggcatgtgtgggaacttcaatgatgaggaagaggacgaactaatgatgcccagcgatgaagtagcaaatagtgacagtgaatttgtgaacagttggaaagataaggacattgacccaagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacaagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtcaacaaccagaagatggccgtcccctacaggccaaatgaacacctgcgggtcaccctgtggggccaacggctctacctggtcaccgactttgagctggtcgtcagctttggtggaaggaaaaatgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagcactgcgtgctggatctgtgctctgctcaggacccaagagagcaagaggagctgcgttgccaggtcctcagtggctgggcagcagctttctgactgaggactgctctcagcggtgcacctgtgccagctcacggatcctgctgtgtgagcccttcagctgcagagcgggggaggtctgcaccctggggaaccacacccaaggctgctttccagaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccagcatctaacctggtgggcgtcctactgggactgctggtgcctgtggtggtcgtactactggccgtgaccagagagtgcatttacagaacgaggaggaagagagagaaaacgcaggagggagacagactggccaggctggtggacacagatactgttctggactgtgcctgttaagttgctcagttttgagctgtcttcagacaagaagattaaataaatttatatatttatttatttga

SEQ ID NO: 204843 - DNA, 8734 bp, Homo sapiens
  Payload ID: 20406
  Gene Name: zonadhesin (gene/pseudogene)
  ENST ID: ENST00000542585
  CDS Start-End: 166-8235
gccatgttgatttctgatccttgagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggaaagagaagcctccggaccagaagctggttgttcgcagctctagggacaactatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccggctgatgtttgagggaacacggggtagcactgcctacctggacatcgccctggatgccctctctatccgccggggctcctgtaatcgcgtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttggggagtatccggaaacacactctcttctcaggacaacctgggcccaactggcaggctgtttctgtcaattacacagccgtgggacggatacagtttgccgtggtaggcgtttttggaaagaccccagagccagctgtggcagttgatgcaaccagcattgctccttgtggggagggttttcctcagtgtgactttgaagacaacgcccatcccttctgtgactgggtccagacttccggggatggtggacactgggccctcggacataaaaatggacccgtccatggcatgggccctgcgggaggtttccctaatgcagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcagcttattttcaagggcatccagggaagcaacacggcctctgtggttgctatgggtttcatcttgatcaatcctgggacttgtccagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgagcctggggcagagtggttcagccccaactgcacagaacattgccgctgctggcccggcagtcgggtcgagtgccagatctctcagtgtgggacacacaccgtgtgccagcttaagaatggccagtatggatgccacccctacgcaggcactgccacctgcttggtctacggagaccctcattatgtcacctttgacgggaggcactttggcttcatgggcaagtgcacttacatcttggcccagccctgtggcaactcaacagacccattcttcagggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtcggggagcgctggtacacagagaacacctgcaccaggctctgcacctgctccgtccacaacaacatcacctgcttccagagcacctgcaaacccaaccagatatgctgggccctggatgggctgctccattgtcgggcctcaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtctgcggcatgtgtgggaacttcaatgatgaggaagaggacgaactaatgatgcccagcgatgaagtagcaaatagtgacagtgaatttgtgaacagttggaaagataaggacattgacccaagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacaagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtcaacaaccagaagatggccgtcccctacaggccaaatgaacacctgcgggtcaccctgtggggccaacggctctacctggtcaccgactttgagctggtcgtcagctttggtggaaggaaaaatgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagcactgcgtgctggatctgtgctctgctcaggacccaagagagcaagaggagctgcgttgccaggtcctcagtgggtacgccatcctctgccaggaggcgggcgctgccctggctggctggcgggaccgcaccctctgcgccatggagtgtccagcaggtaccatatatcagagctgtatgacaccctgcccagcatcctgtgccaacctggcagaccccggggactgcgagggcccctgcgtggaaggctgcgccagcatcccaggctatgcctacagtggcacccagagcctcccctggctgactgtggctgcaccagcaatggcatctactaccagctgggcagcagctttctgactgaggactgctctcagcggtgcacctgtgccagctcacggatcctgctgtgtgagcccttcagctgcagagcgggggaggtctgcaccctggggaaccacacccaaggctgctttccagaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccagcatctaacctggtgggcgtcctactgggactgctggtgcctgtggtggtcgtactactggccgtgaccagagagtgcatttacagaacgaggaggaagagagagaaaacgcaggagggagacagactggccaggctggtggacacagatactgttctggactgtgcctgttaagttgctcagttttgagctgtcttcagacaagaagattaaataaatttatatatttatttatttga

SEQ ID NO: 204844 - DNA, 8535 bp, Homo sapiens
  Payload ID: 20406
  Gene Name: zonadhesin (gene/pseudogene)
  ENST ID: ENST00000538115
  CDS Start-End: 166-8040
gccatgttgatttctgatccttgagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggaaagagaagcctccggaccagaagctggttgttcgcagctctagggacaactatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccggctgatgtttgagggaacacggggtagcactgcctacctggacatcgccctggatgccctctctatccgccggggctcctgtaatcgcgtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttggggagtatccggaaacacactctcttctcaggacaacctgggcccaactggcaggctgtttctgtcaattacacagccgtgggacggatacagtttgccgtggtaggcgtttttggaaagaccccagagccagctgtggcagttgatgcaaccagcattgctccttgtggggagggttttcctcagtgtgactttgaagacaacgcccatcccttctgtgactgggtccagacttccggggatggtggacactgggccctcggacataaaaatggacccgtccatggcatgggccctgcgggaggtttccctaatgcagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcagcttattttcaagggcatccagggaagcaacacggcctctgtggttgctatgggtttcatcttgatcaatcctgggacttgtccagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgagcctggggcagagtggttcagccccaactgcacagaacattgccgctgctggcccggcagtcgggtcgagtgccagatctctcagtgtgggacacacaccgtgtgccagcttaagaatggccagtatggatgccacccctacgcaggcactgccacctgcttggtctacggagaccctcattatgtcacctttgacgggaggcactttggcttcatgggcaagtgcacttacatcttggcccagccctgtggcaactcaacagacccattcttcagggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtcggggagcgctggtacacagagaacacctgcaccaggctctgcacctgctccgtccacaacaacatcacctgcttccagagcacctgcaaacccaaccagatatgctgggccctggatgggctgctccattgtcgggcctcaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtctgcggcatgtgtgggaacttcaatgatgaggaagaggacgaactaatgatgcccagcgatgaagtagcaaatagtgacagtgaatttgtgaacagttggaaagataaggacattgacccaagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacaagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtcaacaaccagaagatggccgtcccctacaggccaaatgaacacctgcgggtcaccctgtggggccaacggctctacctggtcaccgactttgagctggtcgtcagctttggtggaaggaaaaatgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagcactgcgtgctggatctgtgctctgctcaggacccaagagagcaagaggagctgcgttgccaggtcctcagtgggtacgccatcctctgccaggaggcgggcgctgccctggctggctggcgggaccgcaccctctgcgctgggcagcagctttctgactgaggactgctctcagcggtgcacctgtgccagctcacggatcctgctgtgtgagcccttcagctgcagagcgggggaggtctgcaccctggggaaccacacccaaggctgctttccagaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccagcatctaacctggtgggcgtcctactgggactgctggtgcctgtggtggtcgtactactggccgtgaccagagagtgcatttacagaacgaggaggaagagagagaaaacgcaggagggagacagactggccaggctggtggacacagatactgttctggactgtgcctgttaagttgctcagttttgagctgtcttcagacaagaagattaaataaatttatatatttatttatttga

SEQ ID NO: 204845 - DNA, 8378 bp, Homo sapiens
  Payload ID: 20406
  Gene Name: zonadhesin (gene/pseudogene)
  ENST ID: ENST00000546292
  CDS Start-End: 149-8314
tcccagagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggaaagagaagcctccggaccagaagctggttgttcgcagctctagggacaactatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccggctgatgtttgagggaacacggggtagcactgcctacctggacatcgccctggatgccctctctatccgccggggctcctgtaatcgcgtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttggggagtatccggaaacacactctcttctcaggacaacctgggcccaactggcaggctgtttctgtcaattacacagccgtgggacggatacagtttgccgtggtaggcgtttttggaaagaccccagagccagctgtggcagttgatgcaaccagcattgctccttgtggggagggttttcctcagtgtgactttgaagacaacgcccatcccttctgtgactgggtccagacttccggggatggtggacactgggccctcggacataaaaatggacccgtccatggcatgggccctgcgggaggtttccctaatgcagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcagcttattttcaagggcatccagggaagcaacacggcctctgtggttgctatgggtttcatcttgatcaatcctgggacttgtccagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgagcctggggcagagtggttcagccccaactgcacagaacattgccgctgctggcccggcagtcgggtcgagtgccagatctctcagtgtgggacacacaccgtgtgccagcttaagaatggccagtatggatgccacccctacgcaggcactgccacctgcttggtctacggagaccctcattatgtcacctttgacgggaggcactttggcttcatgggcaagtgcacttacatcttggcccagccctgtggcaactcaacagacccattcttcagggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtcggggagcgctggtacacagagaacacctgcaccaggctctgcacctgctccgtccacaacaacatcacctgcttccagagcacctgcaaacccaaccagatatgctgggccctggatgggctgctccattgtcgggcctcaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtctgcggcatgtgtgggaacttcaatgatgaggaagaggacgaactaatgatgcccagcgatgaagtagcaaatagtgacagtgaatttgtgaacagttggaaagataaggacattgacccaagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacaagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtcaacaaccagaagatggccgtcccctacaggccaaatgaacacctgcgggtcaccctgtggggccaacggctctacctggtcaccgactttgagctggtcgtcagctttggtggaaggaaaaatgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagcactgcgtgctggatctgtgctctgctcaggacccaagagagcaagaggagctgcgttgccaggtcctcagtgggtacgccatcctctgccaggaggcgggcgctgccctggctggctggcgggaccgcaccctctgcgaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccagcatctaacctggtgggcgtcctactgggactgctggtgcctgtggtggtcgtactactggccgtgaccagagagtgcatttacagaacgaggaggaagagagagaaaacgcaggagggagacagactggccaggctggtggacacagatactgttctggactgtgcctgttaagttgctcagttttgagctgtcttcagacaagaagattaaataaatttatatatttatttatttg

SEQ ID NO: 204846 - DNA, 8651 bp, Homo sapiens
  Payload ID: 20406
  Gene Name: zonadhesin (gene/pseudogene)
  ENST ID: ENST00000618565
  CDS Start-End: 149-8587
tcccagagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggaaagagaagcctccggaccagaagctggttgttcgcagctctagggacaactatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccggctgatgtttgagggaacacggggtagcactgcctacctggacatcgccctggatgccctctctatccgccggggctcctgtaatcgcgtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttggggagtatccggaaacacactctcttctcaggacaacctgggcccaactggcaggctgtttctgtcaattacacagccgtgggacggatacagtttgccgtggtaggcgtttttggaaagaccccagagccagctgtggcagttgatgcaaccagcattgctccttgtggggagggttttcctcagtgtgactttgaagacaacgcccatcccttctgtgactgggtccagacttccggggatggtggacactgggccctcggacataaaaatggacccgtccatggcatgggccctgcgggaggtttccctaatgcagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcagcttattttcaagggcatccagggaagcaacacggcctctgtggttgctatgggtttcatcttgatcaatcctgggacttgtccagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgagcctggggcagagtggttcagccccaactgcacagaacattgccgctgctggcccggcagtcgggtcgagtgccagatctctcagtgtgggacacacaccgtgtgccagcttaagaatggccagtatggatgccacccctacgcaggcactgccacctgcttggtctacggagaccctcattatgtcacctttgacgggaggcactttggcttcatgggcaagtgcacttacatcttggcccagccctgtggcaactcaacagacccattcttcagggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtcggggagcgctggtacacagagaacacctgcaccaggctctgcacctgctccgtccacaacaacatcacctgcttccagagcacctgcaaacccaaccagatatgctgggccctggatgggctgctccattgtcgggcctcaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtctgcggcatgtgtgggaacttcaatgatgaggaagaggacgaactaatgatgcccagcgatgaagtagcaaatagtgacagtgaatttgtgaacagttggaaagataaggacattgacccaagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacaagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtcaacaaccagaagatggccgtcccctacaggccaaatgaacacctgcgggtcaccctgtggggccaacggctctacctggtcaccgactttgagctggtcgtcagctttggtggaaggaaaaatgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagcactgcgtgctggatctgtgctctgctcaggacccaagagagcaagaggagctgcgttgccaggtcctcagtggccatggagtgtccagcaggtaccatatatcagagctgtatgacaccctgcccagcatcctgtgccaacctggcagaccccggggactgcgagggcccctgcgtggaaggctgcgccagcatcccaggctatgcctacagtggcacccagagcctcccctggctgactgtggctgcaccagcaatggcatctactaccagctgggcagcagctttctgactgaggactgctctcagcggtgcacctgtgccagctcacggatcctgctgtgtgagcccttcagctgcagagcgggggaggtctgcaccctggggaaccacacccaaggctgctttccagaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccagcatctaacctggtgggcgtcctactgggactgctggtgcctgtggtggtcgtactactggccgtgaccagagagtgcatttacagaacgaggaggaagagagagaaaacgcaggagggagacagactggccaggctggtggacacagatactgttctggactgtgcctgttaagttgctcagttttgagctgtcttcagacaagaagattaaataaatttatatatttatttatttg

SEQ ID NO: 204847 - DNA, 8669 bp, Homo sapiens
  Payload ID: 20406
  Gene Name: zonadhesin (gene/pseudogene)
  ENST ID: ENST00000613979
  CDS Start-End: 166-8604
gccatgttgatttctgatccttgagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggaaagagaagcctccggaccagaagctggttgttcgcagctctagggacaactatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccggctgatgtttgagggaacacggggtagcactgcctacctggacatcgccctggatgccctctctatccgccggggctcctgtaatcgcgtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttggggagtatccggaaacacactctcttctcaggacaacctgggcccaactggcaggctgtttctgtcaattacacagccgtgggacggatacagtttgccgtggtaggcgtttttggaaagaccccagagccagctgtggcagttgatgcaaccagcattgctccttgtggggagggttttcctcagtgtgactttgaagacaacgcccatcccttctgtgactgggtccagacttccggggatggtggacactgggccctcggacataaaaatggacccgtccatggcatgggccctgcgggaggtttccctaatgcagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcagcttattttcaagggcatccagggaagcaacacggcctctgtggttgctatgggtttcatcttgatcaatcctgggacttgtccagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgagcctggggcagagtggttcagccccaactgcacagaacattgccgctgctggcccggcagtcgggtcgagtgccagatctctcagtgtgggacacacaccgtgtgccagcttaagaatggccagtatggatgccacccctacgcaggcactgccacctgcttggtctacggagaccctcattatgtcacctttgacgggaggcactttggcttcatgggcaagtgcacttacatcttggcccagccctgtggcaactcaacagacccattcttcagggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtcggggagcgctggtacacagagaacacctgcaccaggctctgcacctgctccgtccacaacaacatcacctgcttccagagcacctgcaaacccaaccagatatgctgggccctggatgggctgctccattgtcgggcctcaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtctgcggcatgtgtgggaacttcaatgatgaggaagaggacgaactaatgatgcccagcgatgaagtagcaaatagtgacagtgaatttgtgaacagttggaaagataaggacattgacccaagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacaagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtcaacaaccagaagatggccgtcccctacaggccaaatgaacacctgcgggtcaccctgtggggccaacggctctacctggtcaccgactttgagctggtcgtcagctttggtggaaggaaaaatgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagcactgcgtgctggatctgtgctctgctcaggacccaagagagcaagaggagctgcgttgccaggtcctcagtggccatggagtgtccagcaggtaccatatatcagagctgtatgacaccctgcccagcatcctgtgccaacctggcagaccccggggactgcgagggcccctgcgtggaaggctgcgccagcatcccaggctatgcctacagtggcacccagagcctcccctggctgactgtggctgcaccagcaatggcatctactaccagctgggcagcagctttctgactgaggactgctctcagcggtgcacctgtgccagctcacggatcctgctgtgtgagcccttcagctgcagagcgggggaggtctgcaccctggggaaccacacccaaggctgctttccagaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccagcatctaacctggtgggcgtcctactgggactgctggtgcctgtggtggtcgtactactggccgtgaccagagagtgcatttacagaacgaggaggaagagagagaaaacgcaggagggagacagactggccaggctggtggacacagatactgttctggactgtgcctgttaagttgctcagttttgagctgtcttcagacaagaagattaaataaatttatatatttatttatttga

SEQ ID NO: 204848 - DNA, 8396 bp, Homo sapiens
  Payload ID: 20406
  Gene Name: zonadhesin (gene/pseudogene)
  ENST ID: ENST00000620596
  CDS Start-End: 166-8331
gccatgttgatttctgatccttgagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggaaagagaagcctccggaccagaagctggttgttcgcagctctagggacaactatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccggctgatgtttgagggaacacggggtagcactgcctacctggacatcgccctggatgccctctctatccgccggggctcctgtaatcgcgtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttggggagtatccggaaacacactctcttctcaggacaacctgggcccaactggcaggctgtttctgtcaattacacagccgtgggacggatacagtttgccgtggtaggcgtttttggaaagaccccagagccagctgtggcagttgatgcaaccagcattgctccttgtggggagggttttcctcagtgtgactttgaagacaacgcccatcccttctgtgactgggtccagacttccggggatggtggacactgggccctcggacataaaaatggacccgtccatggcatgggccctgcgggaggtttccctaatgcagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcagcttattttcaagggcatccagggaagcaacacggcctctgtggttgctatgggtttcatcttgatcaatcctgggacttgtccagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgagcctggggcagagtggttcagccccaactgcacagaacattgccgctgctggcccggcagtcgggtcgagtgccagatctctcagtgtgggacacacaccgtgtgccagcttaagaatggccagtatggatgccacccctacgcaggcactgccacctgcttggtctacggagaccctcattatgtcacctttgacgggaggcactttggcttcatgggcaagtgcacttacatcttggcccagccctgtggcaactcaacagacccattcttcagggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtcggggagcgctggtacacagagaacacctgcaccaggctctgcacctgctccgtccacaacaacatcacctgcttccagagcacctgcaaacccaaccagatatgctgggccctggatgggctgctccattgtcgggcctcaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtctgcggcatgtgtgggaacttcaatgatgaggaagaggacgaactaatgatgcccagcgatgaagtagcaaatagtgacagtgaatttgtgaacagttggaaagataaggacattgacccaagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacaagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtcaacaaccagaagatggccgtcccctacaggccaaatgaacacctgcgggtcaccctgtggggccaacggctctacctggtcaccgactttgagctggtcgtcagctttggtggaaggaaaaatgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagcactgcgtgctggatctgtgctctgctcaggacccaagagagcaagaggagctgcgttgccaggtcctcagtgggtacgccatcctctgccaggaggcgggcgctgccctggctggctggcgggaccgcaccctctgcgaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccagcatctaacctggtgggcgtcctactgggactgctggtgcctgtggtggtcgtactactggccgtgaccagagagtgcatttacagaacgaggaggaagagagagaaaacgcaggagggagacagactggccaggctggtggacacagatactgttctggactgtgcctgttaagttgctcagttttgagctgtcttcagacaagaagattaaataaatttatatatttatttatttga

SEQ ID NO: 204849 - DNA, 6566 bp, Homo sapiens
  Payload ID: 20407
  Gene Name: ZPR1 zinc finger
  Uniprot ID: O75312
  ENST ID: ENST00000227322
  CDS Start-End: 61-1440
gggtggggccgcgagagcggcggaagtaggaagccgaggtctgaattgcgcgtggtggccatggcggccagcggggctgtggaaccagggcccccgggggctgccgtcgccccgtcgcccgccccggccccgccgcctgcccctgatcacctgttccggcccatcagcgccgaggacgaggagcagcagcccaccgagatcgagtcgctatgcatgaactgttactgcaatggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggacatgaacagagaagtggtgaagactgactctgctgccacaaggattcctgagctagattttgaaattcctgcctttagccagaaaggagctctgaccactgttgaaggattgatcacccgtgctatctctggcctggagcaggaccagcctgcacgaagggcaaacaaagatgctacagctgaaagaattgatgagttcattgtcaaactgaaggagctaaagcaagtagcctcccctttcactctgatcattgatgatccctcagggaacagttttgtggaaaacccacatgctcctcagaaagatgatgccctggtgatcacacactacaaccggacccgacagcaggaagagatgctggggcttcaagaagaagcaccagcagagaagccagaagaggaagatctcagaaatgaagtgctccagttcagcacaaactgcccagaatgcaatgcccccgctcagaccaacatgaagctagtacaaatccctcactttaaggaggttatcatcatggctaccaactgcgagaactgtgggcatcggaccaatgaggtgaaatctggaggagcagtagaacccttgggcaccaggatcaccctccacatcacagatgcctcagatatgaccagagacctcctcaagtctgagacttgcagtgtggaaatcccagagctagaatttgaactgggaatggcagtcctcgggggcaagttcaccacactggaagggctgctgaaagacatccgggaactggtgaccaaaaatcctttcacactgggcgacagttccaatcctggacagacggagagactacaggagtttagccagaagatggaccagatcatcgaaggtaacatgaaggcccactttattatggatgatccagcaggaaacagttacttgcagaatgtgtatgcgcctgaagatgatcctgagatgaaggtggagcgttacaagcgcacctttgaccaaaatgaggagctagggctcaatgacatgaagacagagggctatgaggcaggcctggctccgcaacggtagcagtgggtggctcaagggccagcctccagcgctgctctttctgtaggttatttattagtattggatgaaggcgaaggctgggagtgtctttcccaccagcccttgcccatggtggggaggacatctggtctgagtcagagatctgtgcacactttctaaacagcttgtgatgcaagtgtgagcctattgtgttacttgaccttattttggaagttttgaattggcctaggaggaaacccagaaatgaaccaggggtatgtcatcacttttttcatatcaagtcctcaccctccttccacataatgctctatcctctaaggttggaactctgaagttggagaaggtggaataaagttacacctggagtttgttgttggttttgagtatataaaatactgactttgaacaggaaaggagtctcctgaggggagaccgagtccagcacaagtgaaggagttaccattgaaatgatgactttcaaacagcactggcctctgtattgaccctatccttgtttgatatcatgctgttagaattcagcctcctaaagaaaattttcccgtgtatctactgtaatttggggattgcagctggcatttaattcattccttcagcagatgcttgcttatctactttatgccaagcacaccacagaacagaggacaaaataaatctctttcatggaacttgaagtctagtggggaaaaatgacaataaacagatcaggaaaacagtacatcagatggtgattagtgtcatggaggaatgtaaagcagggaatggggctgggttgtgcaaggaaatggggagtagggaagatcttctgaacaagaaggtgataatttgacatttgggcaaagctgaggaggaggtcagggagtgagctgtgtgggtatctgggggaagagatttcctggcagagggaactgcaaatgctagagctgtgaggttagagccagtgggggtacctgatcagttagccctactctcagttagaaatgttgaaacacattcatccagagagaaaggaggctctctgcagttcttctgaaagttaaggaccagtgaacactctgctgcttgggccctggacttcccagccagtgttctttgcactgtagtctcctgcctctcataaacaaaaggtgactcctgtggtgcagactgcagggtatttgttcaataaagaccagttcattgattaagatgttatcacaaaccttattgctttgtgttgcaaactttttttttttttttttttggtagagacagagtctcgcgctgttgcccaggctggagtgcagtggtgtgatcttggcttattgcaacctttgcctcccgggtttaagcaattctgcctcagcctcccgagtagcggggactacaggcgcacgccgccacacccagctaatttcttttgtattttagtagagacggggtttcaccgtgttgcccaggctggtctcgaactcctgagctcaggcaatccgccagccttggcctcccaaagtgctaggattacaggcgtgagctaccgcgtccggctgtgttgcaaacttaactctgaagaatgagttagagatgatttagcaatcagacatctactctcgttgctctgttaaactactctcaaaggtcacaagtgattttccacttggaaagtgttatctatttctgtcacatttgatagtggaccatctcttcttaacccttcttttggctctcgagatactgtacccttggttttcccttcactttgaatatttcttatttggacactttgcctcctcccctcttactaaatttgtttctgagagttctgctttcagacatctctccatatcagattctttggcatcttactatcatgtgggactaacttccatacctgtatctctaatttctgtaagtgagggcgagagtaaggtgtttggagactcaggttagcaaatgactcattcaaactataaagcttcagtactttgggcaaacttctcacaggcaactattctaccctaagagattatctctaggtatgtttccagctgacttgggaatctaagtttaccagacaaccctctgatctatcatttggtctcttaagtagacttccccatagtgtaggtgtgctctgttaagataaactgcagtatcaggttcattttccattgtgaaggaaaaaaaatggcactctggcttattactgaatctcttgtgagtttggttggtgtgaggcaatctcccagaatccacccagttcctaggaaatgatgacctgagtttctgaacttgaagactgaggaccaggtgccagactgggataacccagctaaggtacttcctgccctttgatgacaaggcattcttcagtttcatacccttctcttgaattatctttcagctcctttctcatttcataaagtgtgtcaggatgggagcttacatatagttaactgagtcttgctccacagcacccagcatatgacacatggttaataaaatctgttaaaatcctccatcatagattaaaccctattaggacactagggataacatctataggtaaaaagatagggaaagggtctcgctttaaggccagggtaggtgagtcaaagtgccaggaacatgtggattcagtttcacagccatgagtaacatttaagtggaaaaggtttgtgattgtgttaaaaaaggaaagtggttcatgcatgagggcacgcctcctactttcatgggtcaagtatgtgaaatgcagccatgttcggtcattagacgtgtggacgaacatacaggtaggtactgaatgtacatctgtgtcatgatgagtggaggaggggaggtgagtgttgggagcaagtatgaagggcagttgacttggccaactgaaaactttaatgatggcaacactttcattctaacatcagtatatttccttctttgtacacctgtggtatgtgcctgatgcacactgcagaaaatggtgtctctgcttacatttagggcagtggtggctaagactacttggctttattcctattaaaaaatgttttttacacacttctttttaaggcaaatggcagtgtttccaactgtggagagaaaaagctgcttattttgtgcgttcacctcagtttagtattggcacttccaatgcttgttttcctagtctgtaaaatggggataattaggataaacaaaattatccccattttacaggtgacaaaacagcctcagagaggttacttccagaaggaagcagagctttttttttttttttttttttttttttttttttttgagacggagtctcactctgttgcccagactggagtgcagtggcgtgatcttggctcaccacaacctctgcctcccaggttcaagcgattctcttgcctcagccttctgagtagctgggactacaggtgcacgccaccatgcctggctaattttttttttttttttttttttggagacagtcttgctctgtcacccaggatggagtgcagtggtgcgatcttggctcactgcagccttgcctcctgggttcaagcaattctcctgcctcagcctcctgagtagctgggattacagacgcccaccactgcacccagctaatttttgtatttttagtagagatggggtttcaccatgttggtcaggctggtctcaaacccctgacctcgtgatccacctgccttggcctcccaaagtgcagggattacaggcgtgagccaccgtgcctggccagaagtagagcttctaagaggcaggtgtcaaacccatgccagtcagactctgaaacctgaggtctgaatattttaagctcagctccacaattactgtatttgttctattagatacaactgcagagagaggccaaagctcagagcaggccattggcacggcatctgatcctgcttaactgccctgcagcacagggtggagacacttgggccttgtcaggctaagggactggggtaggatgggtagcagtggaattgaagacaaagaaaacaaatgggcagaagatgggtgggtggaagttcagagggctatcctggcagtgttcactggagcagaagtgtgaggctttctgaatgcctgctgacaccagggtggggcagggctgtgtagtgtgagatgcaccaaattggacgagaagccaaggcaggcttgtgtatggggtaccctggggccctccgcctagtgaagccctatcttctcagcccagcgtcctcgtctcacaagccctcagagccccagcctgctttcctttctgggcctgtgctgcaaccccctcaacatggcccactgggtaaaaattcatgcttcaagactgatccccaagcctgttttgtattatatgagtaaagaattttttaaacacttatccccagataatgtgtatttatttataaagtatagccctgtctgcttgactaatatattaaaaaagtgacctttttgactcttggtccaagaaactattgtttgcacttttgtgtagttgtgtatagcatcctgcaaattctgtcagaagtctgtgatttcagtaacactaaaacttctctctcaaatggtacaagttttcagttttaagacaagttctgggaatctaatgtacaacatgttgactatagctaataattctgtattgtttacttgaagtttgctaagacaaatttgcttaagtgcccccccaccgaactactacataaattagtgaaggatgttttacttaatttgattttggtaatcattacacaatgtataattatatccagtcatcacattgtacaccttgaatatatataattttttgtcaaataataaagctgggaagaaaacgataaaactgacaatctaacatatatgatgaggtaaaaagatctggtatttcaagaaatttggatgacctcttgcaccccacttcgctagcctctactccctagagtcatgttctgactatgtgaagttgagcaacttccttaatcttgccacgcttcagttcttatctgtaaaatatgataatgaaacgatttgagaattgtgagggttaaatgagataattcaggtaaagctctaaaccccctgcaaagaataaagtcttttctttccccccaaaa

SEQ ID NO: 204850 - DNA, 2497 bp, Homo sapiens
  Payload ID: 20407
  Gene Name: ZPR1 zinc finger
  ENST ID: ENST00000444935
  CDS Start-End: 1-1292
tggcggccagcggggctgtggaaccagggcccccgggggctgccgtcgccccgtcgcccgccccggccccgccgcctgcccctgatcacctgttccggcccatcagcgccgaggacgaggagcagcagcccaccgagatcgagtcgctatgcatgaactgttactgcaatggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggacatgaacagagaagtggtgaagactgactctgctgccacaaggattcctgagctagattttgaaattcctgcctttagccagaaaggagctctgaccactgttgaaggattgatcacccgtgctatctctggcctggagcaggaccagcctgcacgaagggcaaacaaagatgctacagctgaaagaattgatgagttcattgtcaaactgaaggagctaaagcaagtagcctcccctttcactctgatcattgatgatccctcagggaacagttttgtggaaaacccacatgctcctcagaaagatgatgccctggtgatcacacactacaaccggacccgacagcaggaagagatgctggggcttcaagaagaagcaccagcagagaagccagaagaggaagatctcagaaatgaagtgctccagttcagcacaaactgcccagaatgcaatgcccccgctcagaccaacatgaagctagtacaaatccctcactttaaggaggttatcatcatggctaccaactgcgagaactgtgggcatcggaccaatgaggtgaaatctggaggagcagtagaacccttgggcaccaggatcaccctccacatcacagatgcctcagatatgaccagagacctcctcaagtctgagacttgcagtgtggaaatcccagagctagaatttgaactgggaatggcagtcctcgggggcaagttcaccacactggaagggctgctgaaagacatccgggaactgatcatcgaaggtaacatgaaggcccactttattatggatgatccagcaggaaacagttacttgcagaatgtgtatgcgcctgaagatgatcctgagatgaaggtggagcgttacaagcgcacctttgaccaaaatgaggagctagggctcaatgacatgaagacagagggctatgaggcaggcctggctccgcaacggtagcagtgggtggctcaagggccagcctccagcgctgctctttctgtaggttatttattagtattggatgaaggcgaaggctgggagtgtctttcccaccagcccttgcccatggtggggaggacatctggtctgagtcagagatctgtgcacactttctaaacagcttgtgatgcaagtgtgagcctattgtgttacttgaccttattttggaagttttgaattggcctaggaggaaacccagaaatgaaccaggggtatgtcatcacttttttcatatcaagtcctcaccctccttccacataatgctctatcctctaaggttggaactctgaagttggagaaggtggaataaagttacacctggagtttgttgttggttttgagtatataaaatactgactttgaacaggaaaggagtctcctgaggggagaccgagtccagcacaagtgaaggagttaccattgaaatgatgactttcaaacagcactggcctctgtattgaccctatccttgtttgatatcatgctgttagaattcagcctcctaaagaaaattttcccgtgtatctactgtaatttggggattgcagctggcatttaattcattccttcagcagatgcttgcttatctactttatgccaagcacaccacagaacagaggacaaaataaatctctttcatggaacttgaagtctagtggggaaaaatgacaataaacagatcaggaaaacagtacatcagatggtgattagtgtcatggaggaatgtaaagcagggaatggggctgggttgtgcaaggaaatggggagtagggaagatcttctgaacaagaaggtgataatttgacatttgggcaaagctgaggaggaggtcagggagtgagctgtgtgggtatctgggggaagagatttcctggcagagggaactgcaaatgctagagctgtgaggttagagccagtgggggtacctgatcagttagccctactctcagttagaaatgttgaaacacattcatccagagagaaaggaggctctctgcagttcttctgaaagttaaggaccagtgaacactctgctgcttgggccctggacttcccagccagtgttctttgcactgtagtctcctgcctctcataaacaaaaggtgactcctgtggtgcagactgcagggtatttgttcaataaagaccagttcattgattaa

SEQ ID NO: 204851 - DNA, 508 bp, Homo sapiens
  Payload ID: 20407
  Gene Name: ZPR1 zinc finger
  ENST ID: ENST00000431973
  CDS Start-End: 1-229
gttccggcccatcagcgccgaggacgaggagcagcagcccaccgagatcgagtcgctatgcatgaactgttactgcaatagaaataatagtgagctccttttcctgcgagcactgtggctggaacaacacggagatccagtcggcaggcaggatccaggaccagggagtgcgctacactttgtctgtcagggctctggaggacatgaacagagaagtggtgaagactgactctgctgccacaaggattcctgagctagattttgaaattcctgcctttagccagaaaggagctctgaccactgttgaaggattgatcacccgtgctatctctggcctggagcaggaccagcctgcacgaagggcaaacaaagatgctacagctgaaagaattgatgagttcattgtcaaactgaaggagctaaagcaagtagcctcccctttcactctgatcattgatgatccctcagggaacagttttgtggaaaacccacatgctcctcagaaaga

SEQ ID NO: 204852 - DNA, 2364 bp, Homo sapiens
  Payload ID: 20407
  Gene Name: ZPR1 zinc finger
  ENST ID: ENST00000429220
  CDS Start-End: 1-1159
cggggctgtggaaccagggcccccgggggctgccgtcgccccgtcgcccgccccggccccgccgcctgcccctgatcacctgttccggcccatcagcgccgaggacgaggagcagcagcccaccgagatcgagtcgctatgcatgaactgttactgcaatgacatgaacagagaagtggtgaagactgactctgctgccacaaggattcctgagctagattttgaaattcctgcctttagccagaaaggagctctgaccactgttgaaggattgatcacccgtgctatctctggcctggagcaggaccagcctgcacgaagggcaaacaaagatgctacagctgaaagaattgatgagttcattgtcaaactgaaggagctaaagcaagtagcctcccctttcactctgatcattgatgatccctcagggaacagttttgtggaaaacccacatgctcctcagaaagatgatgccctggtgatcacacactacaaccggacccgacagcaggaagagatgctggggcttcaagtgctccagttcagcacaaactgcccagaatgcaatgcccccgctcagaccaacatgaagctagtacaaatccctcactttaaggaggttatcatcatggctaccaactgcgagaactgtgggcatcggaccaatgaggtgaaatctggaggagcagtagaacccttgggcaccaggatcaccctccacatcacagatgcctcagatatgaccagagacctcctcaagtctgagacttgcagtgtggaaatcccagagctagaatttgaactgggaatggcagtcctcgggggcaagttcaccacactggaagggctgctgaaagacatccgggaactggtgaccaaaaatcctttcacactgggcgacagttccaatcctggacagacggagagactacaggagtttagccagaagatggaccagatcatcgaaggtaacatgaaggcccactttattatggatgatccagcaggaaacagttacttgcagaatgtgtatgcgcctgaagatgatcctgagatgaaggtggagcgttacaagcgcacctttgaccaaaatgaggagctagggctcaatgacatgaagacagagggctatgaggcaggcctggctccgcaacggtagcagtgggtggctcaagggccagcctccagcgctgctctttctgtaggttatttattagtattggatgaaggcgaaggctgggagtgtctttcccaccagcccttgcccatggtggggaggacatctggtctgagtcagagatctgtgcacactttctaaacagcttgtgatgcaagtgtgagcctattgtgttacttgaccttattttggaagttttgaattggcctaggaggaaacccagaaatgaaccaggggtatgtcatcacttttttcatatcaagtcctcaccctccttccacataatgctctatcctctaaggttggaactctgaagttggagaaggtggaataaagttacacctggagtttgttgttggttttgagtatataaaatactgactttgaacaggaaaggagtctcctgaggggagaccgagtccagcacaagtgaaggagttaccattgaaatgatgactttcaaacagcactggcctctgtattgaccctatccttgtttgatatcatgctgttagaattcagcctcctaaagaaaattttcccgtgtatctactgtaatttggggattgcagctggcatttaattcattccttcagcagatgcttgcttatctactttatgccaagcacaccacagaacagaggacaaaataaatctctttcatggaacttgaagtctagtggggaaaaatgacaataaacagatcaggaaaacagtacatcagatggtgattagtgtcatggaggaatgtaaagcagggaatggggctgggttgtgcaaggaaatggggagtagggaagatcttctgaacaagaaggtgataatttgacatttgggcaaagctgaggaggaggtcagggagtgagctgtgtgggtatctgggggaagagatttcctggcagagggaactgcaaatgctagagctgtgaggttagagccagtgggggtacctgatcagttagccctactctcagttagaaatgttgaaacacattcatccagagagaaaggaggctctctgcagttcttctgaaagttaaggaccagtgaacactctgctgcttgggccctggacttcccagccagtgttctttgcactgtagtctcctgcctctcataaacaaaaggtgactcctgtggtgcagactgcagggtatttgttcaataaagaccagttcattgattaa

SEQ ID NO: 204853 - DNA, 603 bp, Homo sapiens
  Payload ID: 20407
  Gene Name: ZPR1 zinc finger
  ENST ID: ENST00000425791
  CDS Start-End: 50-199
cgagagcggcggaagtaggaagccgaggtctgaattgcgcgtggtggccatggcggccagcggggctgtggaaccagggcccccgggggctgccgtcgccccgtcgcccgccccggccccgccgcctgcccctgatcacctgttccggcccatcagcgccgaggacgaggagcagcagcccaccgagatcgaggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggacatgaacagagaagtggtgaagactgactctgctgccacaaggattcctgagctagattttgaaattcctgcctttagccagaaaggagctctgaccactgttgaaggattgatcacccgtgctatctctggcctggagcaggaccagcctgcacgaagggcaaacaaagatgctacagctgaaagaattgatgagttcattgtcaaactgaaggagctaaagcaagtagcctcccctttcactctg

SEQ ID NO: 204854 - DNA, 691 bp, Homo sapiens
  Payload ID: 20407
  Gene Name: ZPR1 zinc finger
  ENST ID: ENST00000449430
  CDS Start-End: 1-309
attgtcaaactgaaggagctaaagcaagtagcctcccctttcactctgatcattgatgatccctcagggaacagttttgtggaaaacccacatgctcctcagaaagatgatgccctggtgatcacacactacaaccggacccgacagcaggaagagatgctggggcttcaagaagaagcaccagcagagaagccagaagaggaagatctcagaaatgaagtgctccagttcagcacaaactgcccagaatgcaatgcccccgctcagaccaacatgaagctaatggtggtcttgttcgcctggaagtagatttccttaactccgttttccagaaatccctcactttaaggaggttatcatcatggctaccaactgcgagaactgtgggcatcggaccaatgaggtgaaatctggaggagcagtagaacccttgggcaccaggatcaccctccacatcacagatgcctcagatatgaccagagacctcctcaagtctgagacttgcagtgtggaaatcccagagctagaatttgaactgggaatggcagtcctcgggggcaagttcaccacactggaagggctgctgaaagacatccgggaactggtgaccaaaaatcctttcacactgggcgacagttccaatcctggacagacggagagactacaggagtttagccagaagatggaccag

SEQ ID NO: 204855 - DNA, 1456 bp, Homo sapiens
  Payload ID: 20408
  Gene Name: ZW10 interacting kinetochore protein
  ENST ID: ENST00000318387
  CDS Start-End: 10-483
ctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacagggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggtcagacccaactcaggccttggtgtccctggactgcaagtgtggaaggagggaaagcctggtttacctctctctgcatctgagctctgctacccatggagcagatggatggtgggaacaggaaagagcttatgttacacctcattcccatgcttagcccacccagagctaacccctgtcttcttccccaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggtta

SEQ ID NO: 204856 - DNA, 807 bp, Homo sapiens
  Payload ID: 20408
  Gene Name: ZW10 interacting kinetochore protein
  Uniprot ID: O95229
  ENST ID: ENST00000361148
  CDS Start-End: 31-723
ggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaaga

SEQ ID NO: 204857 - DNA, 1872 bp, Homo sapiens
  Payload ID: 20408
  Gene Name: ZW10 interacting kinetochore protein
  Uniprot ID: O95229
  ENST ID: ENST00000373944
  CDS Start-End: 40-873
gggattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacagggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacatttcttctgacttcctttattttcacaatcattcaattcatagcatttcctatattctgttataattatttcattgattcataaatttctttgaaaaataatttggtcttctattgattgtgagaagataatctaagtttaatttggtcagagaatatcatctgtttaataaactttgaaatttggtgagtgaattatcttttttactgataa

SEQ ID NO: 204858 - DNA, 1851 bp, Homo sapiens
  Payload ID: 20408
  Gene Name: ZW10 interacting kinetochore protein
  Uniprot ID: O95229
  ENST ID: ENST00000395405
  CDS Start-End: 38-871
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacagggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggtcagacccaactcaggccttggtgtccctggactgcaagtgtggaaggagggaaagcctggtttacctctctctgcatctgagctctgctacccatggagcagatggatggtgggaacaggaaagagcttatgttacacctcattcccatgcttagcccacccagagctaacccctgtcttcttccccaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacattt

SEQ ID NO: 204859 - DNA, 1621 bp, Homo sapiens
  Payload ID: 20408
  Gene Name: ZW10 interacting kinetochore protein
  ENST ID: ENST00000489649
  CDS Start-End: 30-176
gaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggtatgtacaagatgagagcgagcctttcagaagccagggtctggtcctggctcctcttactgagatacagggcagcactggcagagagcagacttaaggaaacctgtaaggaggtaaggatgttccctgtctctgccctccctctgagcaggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatc

SEQ ID NO: 204860 - DNA, 2992 bp, Homo sapiens
  Payload ID: 20409
  Gene Name: zw10 kinetochore protein
  Uniprot ID: O43264
  ENST ID: ENST00000200135
  CDS Start-End: 146-2485
agtgcgcccctcgccttccgggcggcggtctgaggcccgcgagactccgtttcccggcaggcctcgcgtcaagacggccggcgggacgggagctgcggcgctggctacgagagtgacccagtcagcgttggttcccgtcttggccatggcctcgttcgtgacagaagttttggcacactccgggaggctggaaaaggaggatctggggacccggatcagccgcctgacccggcgggtggaggagatcaagggtgaggtgtgcaatatgattagcaagaagtacagtgaattcctgcctagcatgcagagcgcgcagggcctgattacccaggtggataagctatctgaagacattgacctgctgaaatccaggatagagagtgaggtccgccgggatcttcacgtatcaaccggtgaatttacagacttaaagcagcagttggaaagagactcagttgtcctaagtttgcttaaacagttgcaggagttttccactgctattgaagaatataattgtgcattaacagagaagaagtatgtcactggtgctcagcgtctggaagaggcacagaaatgcttgaagttattaaaatccagaaaatgctttgatttaaaaatattgaaatctctcagcatggagctcacaatacagaaacagaacatactttatcaccttggagaagagtggcagaagctgattgtatggaagttcccaccatcaaaagataccagcagtttggaatcttacctacaaactgaacttcatttatacactgaacaatcgcacaaagaggagaagacccctatgccacccatcagttctgtcctcttggcattttctgttcttggagaactacacagcaagcttaaatcatttggtcagatgctgctgaagtatatccttaggccgctggcatcttgcccatcccttcatgctgtgatagaaagccagcctaacatagttattattcgttttgaatctataatgactaacttggaatatccatcaccatctgaagtttttacaaagatcagactggtactagaagtgctccagaaacagcttctagatttgccacttgacactgacctggaaaatgaaaaaacatctactgtcccattggctgagatgcttggagacatgatctgggaggacttgtctgagtgcctcatcaaaaactgtttggtttattcgattccaacaaatagcagcaaattacagcaatatgaagagatcatacagtccactgaagaatttgaaaatgccctaaaggaaatgagatttttaaaaggagatactacagatttgctgaaatacgctcgtaacatcaattctcattttgcaaacaaaaagtgccaggatgtgattgtggcagccagaaatctaatgacctcagaaattcataacactgtgaagattattcctgattctaagataaatgtgccagagttacccactcctgatgaggataacaaactggaagtacagaaagtatccaatactcagtaccacgaagtgatgaatttagagcctgaaaatacattggaccaacattccttttccttgcccacatgccgtatcagtgagtctgtgaagaaattaatggaactcgcctatcagactttactagaggcaacaaccagtagtgatcaatgtgctgttcaacttttctactcagtgaggaatatcttccatttgttccatgatgttgtaccaacatatcacaaggagaaccttcaaaaacttccccagttggctgctattcatcacaacaactgtatgtacattgctcaccacttgctgaccctcgggcatcagttcagattgcgtcttgcccccattctttgtgatggcactgctacttttgtggatcttgtacctggcttcaggagacttgggacagaatgctttttggcccaaatgcgggcacagaaaggtgaacttctggaaagattatcaagtgctaggaacttttcaaatatggacgatgaagagaattattctgcagcaagtaaagcagtccggcaggtactgcaccaactaaagagacttggaattgtgtggcaggatgtcctgccagtgaatatatattgcaaggctatggggactttactcaatacagcaatttctgaggtcattggcaaaattactgccctagaggacatatctactgaagatggtgataggttatattccttatgcaaaacagtgatggatgaaggaccccaagtatttgcacctttatctgaagaaagcaagaacaagaaatatcaagaagaggttccagtctatgtgccaaaatggatgccattcaaggaattgatgatgatgctacaagccagcttgcaagaaattggggatcggtgggcagatggaaaaggacccctggcagctgcgttctcttccagtgaagtaaaagctttaattcgtgccttgtttcagaacacagaaagaagagcagctgcccttgctaaaattaaatagctccatcttcttaagaaagctatgtcttgaatatgtggattcttcccttggcataattactcccttaaagacttctttgaatcgcccattggttttggtgaaccagtacatcttggaagtttgactttacagaagaacgtcttacctcctggcctgtacgaggctttgtttaagaactgtttattaagataaattgtcaagtaaagcacctcaattcattgactttctagccatcttcctttgattagctaacaaactgtcaggcagcattatttcatgctgcttccagagccctctgggagctatatacattgtaaatgcaggccctagctttggaacgaggaattgggagattccaggagtcagggtagagaatttctgagcaaatcggagatattttaggggtgtggaggaggggaagggaggaatgggccaccatatttggccttacaggaattaaggagacttcctgtaatatttctttccaataaatattgctttttacaa

SEQ ID NO: 204861 - DNA, 892 bp, Homo sapiens
  Payload ID: 20409
  Gene Name: zw10 kinetochore protein
  ENST ID: ENST00000538209
  CDS Start-End: 70-477
gccggcgggacgggagctgcggcgctggctacgagagtgacccagtcagcgttggttcccgtcttggccatggcctcgttcgtgacagaagttttggcacactccgggaggctggaaaaggaggatctggggacccggatcagccgcctgacccggcgggtggaggagatcaagggtgaggtgtgcaatatgattagcaagaagtacagtgaattcctgcctagcatgcagagcgcgcagggcctgattacccaggtggataagctatctgaagacattgacctgctgaaatccaggatagagagtgagataccagcagtttggaatcttacctacaaactgaacttcatttatacactgaacaatcgcacaaagaggagaagacccctatgccacccatcagttctgtcctcttggcattttctgttcttggagaactacacagcaagcttaaatcatttggtcagatgctgctgaagtatatccttaggccgctggcatcttgcccatcccttcatgctgtgatagaaagccagcctaacatagttattattcgttttgaatctataatgactaacttggaatatccatcaccatctgaagtttttacaaagatcagactggtactagaagtgctccagaaacagcttctagatttgccacttgacactgacctggaaaatgaaaaaacatctactgtcccattggctgagatgcttggagacatgatctgggaggacttgtctgagtgcctcatcaaaaactgtttggtttattcgattccaacaaatagcagcaaattacagcaatatgaagagatcatacagtccactgaagaatttgaaaatgccctaaaggaaatgagatttttaaaaggagatactacagattt

SEQ ID NO: 204862 - DNA, 2735 bp, Homo sapiens
  Payload ID: 20409
  Gene Name: zw10 kinetochore protein
  Uniprot ID: O43264
  ENST ID: ENST00000535142
  CDS Start-End: 26-2044
gtcagcgttggttcccgtcttggccatggcctcgttcgtgacagaagttttggcacactccgggaggctggaaaaggaggatctggggacccggatcagccgcctgacccggcgggtggaggagatcaagggtgaggtgtgcaatatgattagcaagaagtacagtgaattcctgcctagcatgcagagcgcgcagggcctgattacccaggtggataagctatctgaagacattgacctgctgaaatccaggatagagagtgaggtccgccgggatcttcacgtatcaaccggtgaatttacagacttaaagcagcagttggaaagagactcagttgtcctaagtttgcttaaacagttgcaggagttttccactgctattgaagaatataattgtgcattaacagagaagaagtatgtcactggtgctcagcgtctggaagaggcacagaaatgcttgaagttattaaaatccagaaaatgctttgatttaaaaatattgaaatctctcagcatggagctcacaatacagaaacagaacatactttatcaccttggagaagagtggcagaagctgattgtatggaagttcccaccatcaaaagataccagcagtttggaatcttacctacaaactgaacttcatttatacactgaacaatcgcacaaagaggagaagacccctatgccacccatcagttctgtcctcttggcattttctgttcttggagaactacacagcaagcttaaatcatttggtcagatgctgctgaagtatatccttaggccgctggcatcttgcccatcccttcatgctgtgatagaaagccagcctaacatagttattattcgttttgaatctataatgactaacttggaatatccatcaccatctgaagtttttacaaagatcagactggtactagaagtgctccagaaacagcttctagatttgccacttgacactgacctggaaaatgaaaaaacatctactgtcccattggctgagatgcttggagacatgatctgggaggacttgtctgagtgcctcatcaaaaactgtttggtttattcgattccaacaaatagcagcaaattacagcaatatgaagagatcatacagtccactgaagaatttgaaaatgccctaaaggaaatgagatttttaaaaggagatactacagatttgctgaaatacgctcgtaacatcaattctcattttgcaaacaaaaagtgccaggatgtgattgtggcagccagaaatctaatgacctcagaaattcataacactgtgaagattattcctgattctaagataaatgtgccagagttacccactcctgatgaggataacaaactggaagtacagaaagtatccaatactcagtaccacgaagtgatgaatttagagcctgaaaatacattggaccaacattccttttccttgcccacatgccgtatcagtgagtctgtgaagaaattaatggaactcgcctatcagactttactagaggcaacaaccagtagtgatcaatgtgctgttcaacttttctactcagtgaggaatatcttccatttgttccatgatgttgtaccaacatatcacaaggagaaccttcaaaaacttccccagttggctgctattcatcacaacaactgtatgtacattgctcaccacttgctgaccctcgggcatcagttcagattgcgtcttgcccccattctttgtgatggcactgctacttttgtggatcttgtacctggcttcaggagacttgggacagaatgctttttggcccaaatgcgggcacagaaaggtgaacttctggaaagattatcaagtgctaggaacttttcaaatatggacgatgaagagaattattctgcagcaagtaaagcagtccggcaggtactgcaccaactaaagagacttggaattgtgtggcaggatgtcctgccagtgaatatatattgcaaggctatggggactttactcaatacagcaatttctgaggtcattggcaaaattactgccctagagtgatggatgaaggaccccaagtatttgcacctttatctgaagaaagcaagaacaagaaatatcaagaagaggttccagtctatgtgccaaaatggatgccattcaaggaattgatgatgatgctacaagccagcttgcaagaaattggggatcggtgggcagatggaaaaggacccctggcagctgcgttctcttccagtgaagtaaaagctttaattcgtgccttgtttcagaacacagaaagaagagcagctgcccttgctaaaattaaatagctccatcttcttaagaaagctatgtcttgaatatgtggattcttcccttggcataattactcccttaaagacttctttgaatcgcccattggttttggtgaaccagtacatcttggaagtttgactttacagaagaacgtcttacctcctggcctgtacgaggctttgtttaagaactgtttattaagataaattgtcaagtaaagcacctcaattcattgactttctagccatcttcctttgattagctaacaaactgtcaggcagcattatttcatgctgcttccagagccctctgggagctatatacattgtaaatgcaggccctagctttggaacgaggaattgggagattccaggagtcagggtagagaatttctgagcaaatcggagatattttaggggtgtggaggagggga

SEQ ID NO: 204863 - DNA, 3960 bp, Homo sapiens
  Payload ID: 20410
  Gene Name: zwilch kinetochore protein
  Uniprot ID: Q9H900
  ENST ID: ENST00000307897
  CDS Start-End: 381-2156
taaaaacgagagtgttatttctttatttgtgggaaattacggtatctattttcttccaaacgtaataataattcttagaaaatagggactcctttttgcggaataatccatagggggcgaggccaactctcgcgagtcgaggtatcttctccccaaccactgctcttattttaattattgcagacggaagttgaagactattgacatagtaaatagctctgggtggcttgaaacgaaagtttaactttgcggacaaacaggacttattgtagggggtggtcaaaatagtcccggcggggcggggccatgacccctgacgtcgccggtccggcgcgcagttcagtttggcggttccggtaccgctctcacattggggcgggatgtgggagcggctgaactgcgcagcagaggacttttattctcgtctccttcagaaatttaatgaagaaaagaaaggaatccgtaaagacccatttctctatgaggctgatgtccaagtgcagttgatcagcaaaggccaaccaaaccctttgaaaaatattctaaatgaaaatgacatagtattcatagtggaaaaagtgcctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaagctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcaaatccctccactctcttcaactgcaactctgaatattaaagtggaatcaggagagcccagaggtcctttgaatcatctctacagagaactgaaatttcttcttgttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtgcaaaatgagcagtagtgtgatttcataccaagacttggtgaagtgtttcacattgatcatccagagtctacaacgtggtgatatacagccatggctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtcaggaacttgcatctttgaatcatttggaatacttcattgctccatcagtagatatacaagaacaggtttatcgtgtccaaaaactccaccatattctagaaatattagtcagttgcatgcctttcattaaatctcaacatgaactcctcttttctttaacacagatctgcataaagtattacaaacaaaatcctcttgatgagcaacacatttttcagctgccagtcagaccaactgctgtaaagaacttatatcaaagtgagaagccacagaaatggagagtggaaatatatagtggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataagcacaagccaaaaagagaaagagaaaaaaaggtaattattgtagaacctgaaaacagcaatgtatggaaaccctcaaagcagaaaagggaggaagatcctgaagattctcttatgaagctccaaaattgataatcctgtctcagctctgcctcctcaggaggagcattagtagaacagcagtgatgaggacacagagggagcagacagtgggtaccacgatctccgtaaccatttgcatgtgacttagcaagggctctgaaatgacaaagagaacgagcaccacaaatgagaacaggatcattttagtaaatacagctttatcccaaaagctttaactgtattgggaaaacttaaaaaatagcatcctcaaattttctgattcttatttgccatgaaatagaacttagtaaattaaatgttatttgaaaatgttataagagctttgtaaatatttcagaaaatatgggataaatgcctgaatttggttcttctacaggtgctataataaagtccatctctcaatacttatactttctaaattcatctcagaatattagcagccatattccacagttcctataatttttactgggggggatttgtgataggaaagtccttgggaaacatttccaatctttcaaaatattattgtgtatcttaagaagtataggaacttgtatgttgaaatgttgtatggtagttcttgtatagttaaataataatctttttaagagttaatgataagcatatgttatgtgcattattaataaaatagtggccacttaggtaatacccacttttatcttgtgtgctgggtactctggttactgagataaataaggcactggacatcctcacgtggagttcacaggctcatcagtgaattctgtaccacatttcaaccttgtttattttagtttaatggaatatacattcttagtattgcctgattatttaaatttgttgagggggattgcatgttgctttattggcctgtaaaaatagctagtttggtaagatttggtctcgcaccttccatctttgctaccacattaaagatgagcttgttaaaaaggaaagcatatttctctgattgcccttatggagaaataaagataaaattcaaagaaacaaataatatgtgttggcatttcttgatgcatagttgcatctttgttattcgacatctctgatccttttagaccccattacataggaaatgatgtcttctatgaagacagggaccttgttttgttcctggctatatctcatgacttaaacattccctggcaaatagtgagtgcttaataattgcttgccgaatgaacaaatataagatctcaagtattcttttttccttcatcccagttggtatagtggttggcttttcctctccttgcccaagcccactataacaaaaatagtaggtatataaatttataggtatgattctgaaagaataaaacttgaatggataaaatggataaaatgtttatctttcatggtagattaaatgctttaaaatgcttataaatagaaatttgacattgcttcaaagaaacctgattttaatcataagtagttttggaagattgacttcaagtagagccacattttgagattttgaaaatgatatgtataattatttagtttaattattaaaggaaaacattgaaatatactgactcacctgcagcaagcatctgattgttgatagagcaagtttccaaagctttgaggtaccaactttccacctaataaaaacccacttgataagt

SEQ ID NO: 204864 - DNA, 3256 bp, Homo sapiens
  Payload ID: 20410
  Gene Name: zwilch kinetochore protein
  Uniprot ID: Q9H900
  ENST ID: ENST00000446801
  CDS Start-End: 660-2093
actgctcttattttaattattgcagacggaagttgaagactattgacatagtaaatagctctgggtggcttgaaacgaaagtttaactttgcggacaaacaggacttattgtagggggtggtcaaaatagtcccggcggggcggggccatgacccctgacgtcgccggtccggcgcgcagttcagtttggcggttccggtaccgctctcacattggggcgggatgtgggagcggctgaactgcgcagcagaggacttttattctcgtctccttcagtgtcctgcagagataaagtgatgactgactcctgagtgtgaataacgggagagataatgtagttctgtttttcacatgtggttctgcgtttcaggaaatttaatgaagaaaagaaaggaatccgtaaagacccatttctctatgaggctgatgtccaagtgcagttgatcagcaaaggccaaccaaaccctttgaaaaatattctaaatgaaaatgacatagtattcatagtggaaaaagtgcctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaagctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcaaatccctccactctcttcaactgcaactctgaatattaaagtggaatcaggagagcccagaggtcctttgaatcatctctacagagaactgaaatttcttcttgttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtgcaaaatgagcagtagtgtgatttcataccaagacttggtgaagtgtttcacattgatcatccagagtctacaacgtggtgatatacagccatggctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtcaggaacttgcatctttgaatcatttggaatacttcattgctccatcagtagatatacaagaacaggtttatcgtgtccaaaaactccaccatattctagaaatattagtcagttgcatgcctttcattaaatctcaacatgaactcctcttttctttaacacagatctgcataaagtattacaaacaaaatcctcttgatgagcaacacatttttcagctgccagtcagaccaactgctgtaaagaacttatatcaaagtgagaagccacagaaatggagagtggaaatatatagtggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataagcacaagccaaaaagagaaagagaaaaaaaggtaattattgtagaacctgaaaacagcaatgtatggaaaccctcaaagcagaaaagggaggaagatcctgaagattctcttatgaagctccaaaattgataatcctgtctcagctctgcctcctcaggaggagcattagtagaacagcagtgatgaggacacagagggagcagacagtgggtaccacgatctccgtaaccatttgcatgtgacttagcaagggctctgaaatgacaaagagaacgagcaccacaaatgagaacaggatcattttagtaaatacagctttatcccaaaagctttaactgtattgggaaaacttaaaaaatagcatcctcaaattttctgattcttatttgccatgaaatagaacttagtaaattaaatgttatttgaaaatgttataagagctttgtaaatatttcagaaaatatgggataaatgcctgaatttggttcttctacaggtgctataataaagtccatctctcaatacttatactttctaaattcatctcagaatattagcagccatattccacagttcctataatttttactgggggggatttgtgataggaaagtccttgggaaacatttccaatctttcaaaatattattgtgtatcttaagaagtataggaacttgtatgttgaaatgttgtatggtagttcttgtatagttaaataataatctttttaagagttaatgataagcatatgttatgtgcattattaataaaatagtggccacttaggtaatacccacttttatcttgtgtgctgggtactctggttactgagataaataaggcactggacatcctcacgtggagttcacaggctcatcagtgaattctgtaccacatttcaaccttgtttattttagtttaatggaatatacattcttagtattgcctgattatttaaatttgttgagggggattgcatgttgctttattggcctgtaaaaatagctagtttggtaagatttggtctcgcaccttccatctttgctaccacattaaagatgagcttgttaaaaaggaaagcatatttctctgattgcccttatggagaaataaagataaaattcaaagaaacaaata

SEQ ID NO: 204865 - DNA, 2206 bp, Homo sapiens
  Payload ID: 20410
  Gene Name: zwilch kinetochore protein
  Uniprot ID: Q9H900
  ENST ID: ENST00000535141
  CDS Start-End: 671-2104
taaaaacgagagtgttatttctttatttgtgggaaattacggtatctattttcttccaaacgtaataataattcttagaaaatagggactcctttttgcggaataatccatagggggcgaggccaactctcgcgagtcgaggtatcttctccccaaccactgctcttattttaattattgcagacggaagttgaagactattgacatagtaaatagctctgggtggcttgaaacgaaagtttaactttgcggacaaacaggacttattgtagggggtggtcaaaatagtcccggcggggcggggccatgacccctgacgtcgccggtccggcgcgcagttcagtttggcggttccggtaccgctctcacattggggcgggatgtgggagcggctgaactgcgcagcagaggacttttattctcgtctccttcagctgatgtccaagtgcagttgatcagcaaaggccaaccaaaccctttgaaaaatattctaaatgaaaatgacatagtattcatagtggaaaaagtgcctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaagctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcaaatccctccactctcttcaactgcaactctgaatattaaagtggaatcaggagagcccagaggtcctttgaatcatctctacagagaactgaaatttcttcttgttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtgcaaaatgagcagtagtgtgatttcataccaagacttggtgaagtgtttcacattgatcatccagagtctacaacgtggtgatatacagccatggctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtcaggaacttgcatctttgaatcatttggaatacttcattgctccatcagtagatatacaagaacaggtttatcgtgtccaaaaactccaccatattctagaaatattagtcagttgcatgcctttcattaaatctcaacatgaactcctcttttctttaacacagatctgcataaagtattacaaacaaaatcctcttgatgagcaacacatttttcagctgccagtcagaccaactgctgtaaagaacttatatcaaagtgagaagccacagaaatggagagtggaaatatatagtggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataagcacaagccaaaaagagaaagagaaaaaaaggtaattattgtagaacctgaaaacagcaatgtatggaaaccctcaa

SEQ ID NO: 204866 - DNA, 1845 bp, Homo sapiens
  Payload ID: 20410
  Gene Name: zwilch kinetochore protein
  Uniprot ID: Q9H900
  ENST ID: ENST00000565627
  CDS Start-End: 386-1819
agttcagtttggcggttccggtaccgctctcacattggggcgggatgtgggagcggctgaactgcgcagcagaggacttttattctcgtctccttcagtgtcctgcagagataaagtgatgactgactcctgagtgtgaataacgggagagataatgtagttctgtttttcacatgtggttctgcgtttcaggaaatttaatgaagaaaagaaaggaatccgtaaagacccatttctctatgagcctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaagctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcaaatccctccactctcttcaactgcaactctgaatattaaagtggaatcaggagagcccagaggtcctttgaatcatctctacagagaactgaaatttcttcttgttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtgcaaaatgagcagtagtgtgatttcataccaagacttggtgaagtgtttcacattgatcatccagagtctacaacgtggtgatatacagccatggctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtcaggaacttgcatctttgaatcatttggaatacttcattgctccatcagtagatatacaagaacaggtttatcgtgtccaaaaactccaccatattctagaaatattagtcagttgcatgcctttcattaaatctcaacatgaactcctcttttctttaacacagatctgcataaagtattacaaacaaaatcctcttgatgagcaacacatttttcagctgccagtcagaccaactgctgtaaagaacttatatcaaagtgagaagccacagaaatggagagtggaaatatatagtggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataag

SEQ ID NO: 204867 - DNA, 355 bp, Homo sapiens
  Payload ID: 20410
  Gene Name: zwilch kinetochore protein
  ENST ID: ENST00000569489
  CDS Start-End: 1-147
acagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataaggtatttatgttcacattttagtctctttgtcaaatactttgtaataagtaccttacgtttagttctttctacattatcaatgtcgatttgctacattaggaatagggattattagtaatcacataaaaggcttaccagttgttattgagcagtgcaactctttaattttctttctacctttt

SEQ ID NO: 204868 - DNA, 373 bp, Homo sapiens
  Payload ID: 20410
  Gene Name: zwilch kinetochore protein
  ENST ID: ENST00000567816
  CDS Start-End: 1-297
atctgcataaagtattacaaacaaaatcctcttgatgagcaacacatttttcagctgccagtcagaccaactgctgtaaagaacttatatcaaagtgagaagccacagaaatggagagtggaaatatatagtggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataaggctggagtgcagtggcgctatctcggctcactgcaagctccgcctcccag

SEQ ID NO: 204869 - DNA, 582 bp, Homo sapiens
  Payload ID: 20410
  Gene Name: zwilch kinetochore protein
  ENST ID: ENST00000564179
  CDS Start-End: 330-582
agtttggcggttccggtaccgctctcacattggggcgggatgtgggagcggctgaactgcgcagcagaggacttttattctcgtctccttcagctgatgtccaagtgcagttgatcagcaaaggccaaccaaaccctttgaaaaatattctaaatgaaaatgacatagtattcatagtggaaaaagtgcctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaagctgataaaaattattctgtaaatcttgaaaacctaaaaaatttacacaagaaaagacatcacttgtctactgtaa

SEQ ID NO: 204870 - DNA, 3181 bp, Homo sapiens
  Payload ID: 20410
  Gene Name: zwilch kinetochore protein
  Uniprot ID: Q9H900
  ENST ID: ENST00000613446
  CDS Start-End: 598-2031
aactctcgcgagtcgaggtatcttctccccaaccactgctcttattttaattattgcagacggaagttgaagactattgacatagtaaatagctctgggtggcttgaaacgaaagtttaactttgcggacaaacaggacttattgtagggggtggtcaaaatagtcccggcggggcggggccatgacccctgacgtcgccggtccggcgcgcagttcagtttggcggttccggtaccgctctcacattggggcgggatgtgggagcggctgaactgcgcagcagaggacttttattctcgtctccttcagtgtcctgcagagataaagtgatgactgactcctgagtgtgaataacgggagagataatgtagttctgtttttcacatgtggttctgcgtttcaggaaatttaatgaagaaaagaaaggaatccgtaaagacccatttctctatgagcctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaagctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcaaatccctccactctcttcaactgcaactctgaatattaaagtggaatcaggagagcccagaggtcctttgaatcatctctacagagaactgaaatttcttcttgttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtgcaaaatgagcagtagtgtgatttcataccaagacttggtgaagtgtttcacattgatcatccagagtctacaacgtggtgatatacagccatggctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtcaggaacttgcatctttgaatcatttggaatacttcattgctccatcagtagatatacaagaacaggtttatcgtgtccaaaaactccaccatattctagaaatattagtcagttgcatgcctttcattaaatctcaacatgaactcctcttttctttaacacagatctgcataaagtattacaaacaaaatcctcttgatgagcaacacatttttcagctgccagtcagaccaactgctgtaaagaacttatatcaaagtgagaagccacagaaatggagagtggaaatatatagtggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataagcacaagccaaaaagagaaagagaaaaaaaggtaattattgtagaacctgaaaacagcaatgtatggaaaccctcaaagcagaaaagggaggaagatcctgaagattctcttatgaagctccaaaattgataatcctgtctcagctctgcctcctcaggaggagcattagtagaacagcagtgatgaggacacagagggagcagacagtgggtaccacgatctccgtaaccatttgcatgtgacttagcaagggctctgaaatgacaaagagaacgagcaccacaaatgagaacaggatcattttagtaaatacagctttatcccaaaagctttaactgtattgggaaaacttaaaaaatagcatcctcaaattttctgattcttatttgccatgaaatagaacttagtaaattaaatgttatttgaaaatgttataagagctttgtaaatatttcagaaaatatgggataaatgcctgaatttggttcttctacaggtgctataataaagtccatctctcaatacttatactttctaaattcatctcagaatattagcagccatattccacagttcctataatttttactgggggggatttgtgataggaaagtccttgggaaacatttccaatctttcaaaatattattgtgtatcttaagaagtataggaacttgtatgttgaaatgttgtatggtagttcttgtatagttaaataataatctttttaagagttaatgataagcatatgttatgtgcattattaataaaatagtggccacttaggtaatacccacttttatcttgtgtgctgggtactctggttactgagataaataaggcactggacatcctcacgtggagttcacaggctcatcagtgaattctgtaccacatttcaaccttgtttattttagtttaatggaatatacattcttagtattgcctgattatttaaatttgttgagggggattgcatgttgctttattggcctgtaaaaatagctagtttggtaagatttggtctcgcaccttccatctttgctaccacattaaagatgagcttgttaaaaaggaaagcatatttctctgattgcccttatggagaaataaagataaaattc

SEQ ID NO: 204871 - DNA, 2579 bp, Homo sapiens
  Payload ID: 20411
  Gene Name: ZXD family zinc finger C
  Uniprot ID: Q2QGD7
  ENST ID: ENST00000336332
  CDS Start-End: 1-2133
atggacctcccggcgctgctccccgccccgactgcgcgcggagggcaacatggcggcggccccggcccgctccgccgagccccagcgccgctcggcgcgagccccgcgcgccgccgcctgctactggtgcggggccctgaagatggcgggcccggggcgcggcccggggaggcctccgggccaagcccgccgcccgccgaggacgacagcgacggcgactctttcttggtgctgctggaagtgccgcacggcggcgctgccgccgaggctgccggatcacaggaggccgagcctggctcccgtgtcaacctggcgagccgccccgagcagggccccagcggcccggccgccccccccggccctggcgtagccccggcgggcgccgtcaccatcagcagccaggacctgctggtgcgtctcgaccgcggcgtcctcgcgctgtctgcgccgcccggccccgcaaccgcgggcgccgccgctccccgccgcgcgccccaggcctccggccccagcacgcccggctaccgctgccccgagccgcagtgcgcgctggccttcgccaagaagcaccagctcaaggtgcacctgctcacgcacggcggcggtcagggccggcggcccttcaagtgcccactggagggctgtggttgggccttcacaacgtcctacaagctcaagcggcacctgcagtcgcacgacaagctgcggcccttcggctgtccagtgggcggctgtggcaagaagttcactacggtctataacctcaaggcgcacatgaagggccacgagcaggagagcctgttcaagtgcgaggtgtgcgccgagcgcttccccacgcacgccaagctcagctcccaccagcgcagccacttcgagcccgagcgcccttacaagtgtgactttcccggctgtgagaagacatttatcacagtgagtgccctgttttcccataaccgagcccacttcagggaacaagagctcttttcctgctcctttcctgggtgcagcaagcagtatgataaagcctgtcggctgaaaattcacctgcggagccatacaggtgaaagaccatttatttgtgactctgacagctgtggctggaccttcaccagcatgtccaaacttctaaggcacagaaggaaacatgacgatgaccggaggtttacctgccctgtcgagggctgtgggaaatcattcaccagagcagagcatctgaaaggccacagcataacccacctaggcacaaagccgttcgagtgtcctgtggaaggatgttgcgcgaggttctccgctcgtagcagtctgtacattcactctaagaaacacgtgcaggatgtgggtgctccgaaaagccgttgcccagtttctacctgcaacagactcttcacctccaagcacagcatgaaggcgcacatggtcagacagcacagccggcgccaagatctcttacctcagctagaagctccgagttctcttactcccagcagtgaactcagcagcccaggccaaagtgagctcactaacatggatcttgctgcactcttctctgacacacctgccaatgctagtggttctgcaggtgggtcggatgaggctctgaactccggaatcctgactattgacgtcacttctgtgagctcctctctgggagggaacctccctgctaataatagctccctagggccgatggaacccctggtcctggtggcccacagtgatattcccccaagcctggacagccctctggttctcgggacagcagccacggttctgcagcagggcagcttcagtgtggatgacgtgcagactgtgagtgcaggagcattaggctgtctggtggctctgcccatgaagaacttgagtgacgacccactggctttgacctccaatagtaacttagcagcacatatcaccacaccgacctcttcgagcaccccccgagaaaatgccagtgtcccggaactgctggctccaatcaaggtggagccggactcgccttctcgcccaggagcagttgggcagcaggaaggaagccatgggctgccccagtccacgttgcccagtccagcagagcagcacggtgcccaggacacagagctcagtgcaggcactggcaacttctatttggtatgaagcactctattcagtcaccaccatataggtcacttctctcatactcggtcttgaggatattctggattaatcctttctatgcagacgtttctggtttacaaaaggacgcagccctggactacaagtctggaactgacaagttcttatgaccttgacaaatcaccttaacccatctgagccttaaattctcatttatttcctgcataaggagatttggctaaatgctttctgaggtcctttggagtcctgtggctccatggtaatgtgctcctttccttgaagattgggggttttgtaatgttgagatactttgcctctatgcttgtcagctcatgaccagtcctagaagaggagtcgagacataagccaccttcagaggttcaatggaaactttaaaaccataccaaactcttttttaaaattagaattaacaagaaaaaaaaaaa

SEQ ID NO: 204872 - DNA, 3405 bp, Homo sapiens
  Payload ID: 20411
  Gene Name: ZXD family zinc finger C
  Uniprot ID: Q2QGD7
  ENST ID: ENST00000389709
  CDS Start-End: 55-2631
gggcgcgggcagctctgcgtccgaagctgctccgacgccgtcgctgggaccaagatggacctcccggcgctgctccccgccccgactgcgcgcggagggcaacatggcggcggccccggcccgctccgccgagccccagcgccgctcggcgcgagccccgcgcgccgccgcctgctactggtgcggggccctgaagatggcgggcccggggcgcggcccggggaggcctccgggccaagcccgccgcccgccgaggacgacagcgacggcgactctttcttggtgctgctggaagtgccgcacggcggcgctgccgccgaggctgccggatcacaggaggccgagcctggctcccgtgtcaacctggcgagccgccccgagcagggccccagcggcccggccgccccccccggccctggcgtagccccggcgggcgccgtcaccatcagcagccaggacctgctggtgcgtctcgaccgcggcgtcctcgcgctgtctgcgccgcccggccccgcaaccgcgggcgccgccgctccccgccgcgcgccccaggcctccggccccagcacgcccggctaccgctgccccgagccgcagtgcgcgctggccttcgccaagaagcaccagctcaaggtgcacctgctcacgcacggcggcggtcagggccggcggcccttcaagtgcccactggagggctgtggttgggccttcacaacgtcctacaagctcaagcggcacctgcagtcgcacgacaagctgcggcccttcggctgtccagtgggcggctgtggcaagaagttcactacggtctataacctcaaggcgcacatgaagggccacgagcaggagagcctgttcaagtgcgaggtgtgcgccgagcgcttccccacgcacgccaagctcagctcccaccagcgcagccacttcgagcccgagcgcccttacaagtgtgactttcccggctgtgagaagacatttatcacagtgagtgccctgttttcccataaccgagcccacttcagggaacaagagctcttttcctgctcctttcctgggtgcagcaagcagtatgataaagcctgtcggctgaaaattcacctgcggagccatacaggtgaaagaccatttatttgtgactctgacagctgtggctggaccttcaccagcatgtccaaacttctaaggcacagaaggaaacatgacgatgaccggaggtttacctgccctgtcgagggctgtgggaaatcattcaccagagcagagcatctgaaaggccacagcataacccacctaggcacaaagccgttcgagtgtcctgtggaaggatgttgcgcgaggttctccgctcgtagcagtctgtacattcactctaagaaacacgtgcaggatgtgggtgctccgaaaagccgttgcccagtttctacctgcaacagactcttcacctccaagcacagcatgaaggcgcacatggtcagacagcacagccggcgccaagatctcttacctcagctagaagctccgagttctcttactcccagcagtgaactcagcagcccaggccaaagtgagctcactaacatggatcttgctgcactcttctctgacacacctgccaatgctagtggttctgcaggtgggtcggatgaggctctgaactccggaatcctgactattgacgtcacttctgtgagctcctctctgggagggaacctccctgctaataatagctccctagggccgatggaacccctggtcctggtggcccacagtgatattcccccaagcctggacagccctctggttctcgggacagcagccacggttctgcagcagggcagcttcagtgtggatgacgtgcagactgtgagtgcaggagcattaggctgtctggtggctctgcccatgaagaacttgagtgacgacccactggctttgacctccaatagtaacttagcagcacatatcaccacaccgacctcttcgagcaccccccgagaaaatgccagtgtcccggaactgctggctccaatcaaggtggagccggactcgccttctcgcccaggagcagttgggcagcaggaaggaagccatgggctgccccagtccacgttgcccagtccagcagagcagcacggtgcccaggacacagagctcagtgcaggcactggcaacttctatttggaaagtgggggctcagcaagaactgattaccgagccattcaactagccaaggaaaaaaagcagagaggagcggggagcaatgcaggagcctcacagtctactcagagaaaaataaaagaaggcaaaatgagtcctccccatttccatgcaagccagaacagttggttgtgtgggagcctcgtggtgcccagcggaggacggccaggaccagctccagcagctggggtgcagtgcggggcgcagggcgtccaggtccagctggtgcaggatgacccctccggcgaaggtgtcctgccctcggcccgcggcccagccaccttcctccccttcctcactgtggacctgcccgtctacgtcctccaggaggtgctcccctcatctggaggccctgctggaccggaggccacccagttcccaggaagcactatcaacctgcaggatctgcagtgacggcagcctcggcctgggcaggcccaaggccacggtctaggacacaccttccctgagactcatgacatgagcctggggagacctcatttggtttccgttcagaagaccagcgtagcccttttgagacttttgggtacatttatcaaaaatgttttccttttgttttaccaggaatgagttcgggctatactctttgaaactgcctttgtgagcaaagtgctttggcaaggcaagggtctccctcagcagggctaggtgcactacagcctctttccccgtgtcccgttggatctgagctgtgtagcacttgttgcattacaaagaaaaagacttctgcaggaaatagggtagagaacaggctgtctagtcagatgcagcttgatctgtggcaaaaccaagtgtggtctttcagcttcagtgtgttagcatcccagcacctgggatggggtttgtgggcaagttgattttgccacactgtagggcccaggtggtcccattgccaccgtgaagccaaattctagcccaagtctggtagagcagtcgggcagctagttttcgggggaggatgatgtggtgggacagaggacctcagtggcctattacggagccctcttcccagactaaattcatagccgagagctcggggggatggtagagttaaaatttaaaataattttctaaattctgtatttggatattagtgtttaagtggtaatttggcaacagtttataaagtgatgttctgaataccataaattatgtgtaggactgtga

SEQ ID NO: 204873 - DNA, 2635 bp, Homo sapiens
  Payload ID: 20411
  Gene Name: ZXD family zinc finger C
  ENST ID: ENST00000515545
  CDS Start-End: 1-1255
cgagcgcccttacaagtgtgactttcccggctgtgagaagacatttatcacagtgagtgccctgttttcccataaccgagcccacttcagggaacaagagctcttttcctgctcctttcctgggtgcagcaagcagtatgataaagcctgtcggctgaaaattcacctgcggagccatacaggtgaaagaccatttatttgtgactctgacagctgtggctggaccttcaccagcatgtccaaacttctaaggcacagaaggaaacatgacgatgaccggaggtttacctgccctgtcgagggctgtgggaaatcattcaccagagcagagcatctgaaaggccacagcataacccacctaggcacaaagccgttcgagtgtcctgtggaaggatgttgcgcgaggttctccgctcgtagcagtctgtacattcactctaagaaacacgtgcaggatgtgggtgctccgaaaagccgttgcccagtttctacctgcaacagactcttcacctccaagcacagcatgaaggcgcacatggtcagacagcacagccggcgccaagatctcttacctcagctagaagctccgagttctcttactcccagcagtgaactcagcagcccaggccaaagtgagctcactaacatggatcttgctgcactcttctctgacacacctgccaatgctagtggttctgcaggtgggtcggatgaggctctgaactccggaatcctgactattgacgtcacttctgtgagctcctctctgggagggaacctccctgctaataatagctccctagggccgatggaacccctggtcctggtggcccacagtgatattcccccaagcctggacagccctctggttctcgggacagcagccacggttctgcagcagggcagcttcagtgtggatgacgtgcagactgtgagtgcaggagcattaggctgtctggtggctctgcccatgaagaacttgagtgacgacccactggctttgacctccaatagtaacttagcagcacatatcaccacaccgacctcttcgagcaccccccgagaaaatgccagtgtcccggaactgctggctccaatcaaggtggagccggactcgccttctcgcccaggagcagttgggcagcaggaaggaagccatgggctgccccagtccacgttgcccagtccagcagagcagcacggtgcccaggacacagagctcagtgcaggcactggcaacttctatttggtatgaagcactctattcagtcaccaccatataggtcacttctctcatactcggtcttgaggatattctggattaatcctttctatgcagacgtttctggtttacaaaaggacgcagccctggactacaagtctggaactgacaagttcttatgaccttgacaaatcaccttaacccatctgagccttaaattctcatttatttcctgcataaggagatttggctaaatgctttctgaggtcctttggagtcctgtggctccatggagcctcacagtctactcagagaaaaataaaagaaggcaaaatgagtcctccccatttccatgcaagccagaacagttggttgtgtgggagcctcgtggtgcccagcggaggacggccaggaccagctccagcagctggggtgcagtgcggggcgcagggcgtccaggtccagctggtgcaggatgacccctccggcgaaggtgtcctgccctcggcccgcggcccagccaccttcctccccttcctcactgtggacctgcccgtctacgtcctccaggaggtgctcccctcatctggaggccctgctggaccggaggccacccagttcccaggaagcactatcaacctgcaggatctgcagtgacggcagcctcggcctgggcaggcccaaggccacggtctaggacacaccttccctgagactcatgacatgagcctggggagacctcatttggtttccgttcagaagaccagcgtagcccttttgagacttttgggtacatttatcaaaaatgttttccttttgttttaccaggaatgagttcgggctatactctttgaaactgcctttgtgagcaaagtgctttggcaaggcaagggtctccctcagcagggctaggtgcactacagcctctttccccgtgtcccgttggatctgagctgtgtagcacttgttgcattacaaagaaaaagacttctgcaggaaatagggtagagaacaggctgtctagtcagatgcagcttgatctgtggcaaaaccaagtgtggtctttcagcttcagtgtgttagcatcccagcacctgggatggggtttgtgggcaagttgattttgccacactgtagggcccaggtggtcccattgccaccgtgaagccaaattctagcccaagtctggtagagcagtcgggcagctagttttcgggggaggatgatgtggtgggacagaggacctcagtggcctattacggagccctcttcccagactaaattcatagccgagagctcggggggatggtagagttaaaatttaaaataattttctaaattctgtatttggatattagtgtttaagtggtaatttggcaacagtttataaagtgatgttctgaataccataaa

SEQ ID NO: 204874 - DNA, 4469 bp, Homo sapiens
  Payload ID: 20412
  Gene Name: zyg-11 family member A, cell cycle regulator
  Uniprot ID: Q6WRX3
  ENST ID: ENST00000371528
  CDS Start-End: 149-2428
aaaagctcgccggcagggcgcggcgctagctccgtgtgcctcgcaggcgtggtgggcgcgtcctggcagccgcccgcttggttctcgcgggatccgggctccggctcgacgccggctctctttttgacgccccgccgccggggttgccatggttcatttcttgcacccgggccacacgccccggaacatcgtccctcctgacgctcagaaggatgccctgggctgctgcgtggtacaggaagaggcatctccctacactttggtcaacatctgcctgaatgtcctgattgctaacctggagaaattgtgttctgaaagacctgatggaacactgtgccttccggagcattggagtttccctcaggaagtagccgagcgatttctcagggtgatgacttggcaaggcaagctgactgacagaacagccagcattttccgaggcaaccaaatgaaactgaagctggtcaatatccaaaaagctaaaatctctacagctgcattcataaaagccttctgccgtcataagctcattgaactgaatgctactgcagtgcacgctgacctcccagttccagacatcataagtggactctgcagcaataggtggatccagcaaaacctccagtgtctcctgttagactcgacaagcatccctcaaaattcaagattactgttctttagtcagctcactggtcttcgcattttaagtgtttttaatgtttgttttcatactgaagacctggctaatgtttctcagttaccaagactggaaagcttagatatctctaatactctagtcactgatatttctgcactgcttacctgtaaggatcgattgaagtctctcacaatgcactatctgaaatgcctggccatgaccaaatcacaaattcttgcagtcattagagaacttaaatgtctgcttcaccttgatatttctgatcacaggcaactcaaatcagacctagcttttcatttgctacagcagaaggatatcctgcccaatgttgtgtcattggatatttctgggggcaattgcatcactgatgaagctgtagaactgtttatacgactgcggcctgccatgcaatttgtgggactattggccacggatgctggctcttctgacttctttactacaaagcaaggcttgagggttgctggaggagccagtatgagtcagatttcagaagcactgagccgatacaggaacagatcatgttttgtgaaggaagccctccacaggctgttcacagagacattttcaatggaggtaaccatgcctgctattttaaagcttgtggctataggaatgaggaatcacccattggatttgcgagtgcagttcacagccagtgcttgcgctctcaacctaacacgccagggcctggccaaggggatgcctgttcgcctgttgtcagaggtcacctgtctacttttcaaggctctgaaaaatttcccccattaccagcagttacagaagaattgtcttctctccttaaccaattccaggattcttgtggatgttccatttgacaggtttgatgctgccaagtttgtcatgagatggctctgtaagcatgaaaaccccaagatgcaaacaatggcagtgagtgtcacctctattctggctctgcagctctcacctgagcaaacggcacagcttgaagagcttttcatggcagttaaggaacttctagcaatagtaaaacaaaagactactgagaatttagatgatgtcaccttcttgtttactttgaaagcactttggaatcttacagatgggtctccagctgcctgcaagcacttcattgaaaatcaaggattgcaaatcttcatccaagtcttggagaccttttcagagtcagcaatacaaagcaaagtacttggtcttttgaacaacatagcagaagtcagagagctctcttccaagctggtgaccgaagatgtgctgaagcatatcaacagtttactctgtagcagggaaatggaagtcagctattttgctgcaggtatcatagcccacctgacatctgacagacagctttggatatcccgtgacttccagaggcgtactcttctccaagatctgcatgcaaccatacagaattggccaagttcaagttgtaagatgacagcattggtgacctatagatctttcaagacatttttcccgctccttggcaacttctctcaaccagaggttcagctctgggcactatgggctatgtatcatgtctgcagtaaaaatcccagcaaatactgcaaaatgttagttgaagaagaaggattgcagcttttgtgtgatatccaggagcacagtgaggcaacccccaaagcacagcagattgcagcctccattctggatgacttcagaatgcatttcatgaattatcagaggcccactctgtgtcaaatgcccttctgaacctaaggaatttcagaggtgtgtgctcttcctcaatgtcaggtgttctgccctggcagtaattgcacatcagttgtcattggagtttgtgagttggctgtctcattggcctttgattgttgattttatatatgttacaaaaggttggatttgtatgatagctgtaatcccaagtcaagttggactcattctgcagcctttcagcagcaattttgaagactcaaaccgtggactctgggaaggcctgggagcttgtgttggaacagctatgcaagttacttttctctagccttggacaattttttccctttgggagcttgtcatgggagtgggacctgttcactagaagagaaaggaaacctacagggagactttgatatttatattaaatttcctttgttgttatcgtcatgtgaagctatgagaaaagcttgggaagcatatgcttcaaaatgtagtgtttagaaggcagaacccctgttggagagcggggaaaagaatttatttatttatttatttatctatggctgggtatggtggctcacgcctgtaatcccagcactttgggaggccaaggcaggtggattgtctgaactcaggagttcgagatcagccttgccaacgtggtaaaactccgtctctaccaaaaaatacaaaaattagctgagcgtggtggtgtgcacctttactcctagctacttggaggctgaggtgggaggaccacttgagcccaggaggcagaggttgcagtgagctgagattgcaccactgcactccagcctggatgacagagtgagacctcatctcaaatgaatagaggggtggagaaaagagaaatatatttttttacctttttttttttttttttttttgtgacggaatctcgctctgtcgcccaggctggagtgcagtggcacaatctcggctcactgcaacctctgcctcccaggttccagcaattctcctgcctcagcctcctgagtagctgggactacaggcacatgccgccacgcccggctaatttttgtattttttagtagagacagggtttcaccatattggtcaggctggtctcgacctcctgacctcgtgatccacccgtctcggcctcccaaagtgctgggattacaggtgtgagtcactgcacctggcctttttacaattttgggtgtctatctttggcatgtttcctgttatgtgagcatgacatgctgtgtatgtgagtgagcttgtagggcgtggtgggacttaggcatttgcagacagtgtttagatgaaagattacatgtaatgataaatctgaatccctccattttatttgggtggaaccatgaccaaaaatggtaggaagacgaaaggccagaaagagactttgccagagagttcacggagttttcttaccccgcatgctgactaaagaaaacatgggcttttctgaaaccagcttcaactacagtataaactatatcagaagcttacttgataagccttgcggagctgctctgaggaatagtgtgaattccttccttgccttattgttgactgttaatgaacatgttttgtcatttatctgtttaagtttttcagaaaataaaagtaaatttctgttagcacattttaggattagatttttgtgcttttggctggcttggttcagattcttaactagagtaccatgtactgtctttggaaatcaaatgaggaagaagctcattctcttactctaaaccatgttccaaactattaccagagtccaaccagataagcagaatttgtaaccttacttccttccatagtccttaaactgtactgtattttttcacactcttgcatgattccaaaaggatatcttcctgacctgggttctagtacctcagagcattgttatcagatgctagcttattctaatgtgaggatgtgttaggggaactagtgtgttaagtccaattctgtacaagacatcctttcaagttctgtgtcattcacaacaatcctcacgggtaggtgagttttattttcctcacttaacagatgagaaaaa

SEQ ID NO: 204875 - DNA, 3942 bp, Homo sapiens
  Payload ID: 20412
  Gene Name: zyg-11 family member A, cell cycle regulator
  Uniprot ID: Q6WRX3
  ENST ID: ENST00000371532
  CDS Start-End: 648-1901
gggaatatcctctcaagccctgaggtgcagggctgggaaggagtgggtgagcggctgggtcgtggcaggttggtctggggaggctggggaggctggggaggcgggaggagaacggttggccccggcagcggcgtgtcggagggcggatggggctaggaggccgcccggggggtggggtctgcggcgggccggcccccgcgtgcgcgtcgcctcgccgggcatttcaaaagctcgccggcagggcgcggcgctagctccgtgtgcctcgcaggcgtggtgggcgcgtcctggcagccgcccgcttggttctcgcgggatccgggctccggctcgacgccggctctctttttgacgccccgccgccggggttgccatggttcatttcttgcacccgggccacacgccccggaacatcgtccctcctgacgctcagaaggatgccctgggctgctgcgtggtacaggaagaggcatctccctacactttggtcaacatctgcctgaatgtcctgattgctaacctggagaaattgtgttctgaaagacctgatggaacactgtgccttccggagcattggagtttccctcaggaagtagccgagcgatttctcagggtgatgacttggcaaggttgctggaggagccagtatgagtcagatttcagaagcactgagccgatacaggaacagatcatgttttgtgaaggaagccctccacaggctgttcacagagacattttcaatggaggtaaccatgcctgctattttaaagcttgtggctataggaatgaggaatcacccattggatttgcgagtgcagttcacagccagtgcttgcgctctcaacctaacacgccagggcctggccaaggggatgcctgttcgcctgttgtcagaggtcacctgtctacttttcaaggctctgaaaaatttcccccattaccagcagttacagaagaattgtcttctctccttaaccaattccaggattcttgtggatgttccatttgacaggtttgatgctgccaagtttgtcatgagatggctctgtaagcatgaaaaccccaagatgcaaacaatggcagtgagtgtcacctctattctggctctgcagctctcacctgagcaaacggcacagcttgaagagcttttcatggcagttaaggaacttctagcaatagtaaaacaaaagactactgagaatttagatgatgtcaccttcttgtttactttgaaagcactttggaatcttacagatgggtctccagctgcctgcaagcacttcattgaaaatcaaggattgcaaatcttcatccaagtcttggagaccttttcagagtcagcaatacaaagcaaagtacttggtcttttgaacaacatagcagaagtcagagagctctcttccaagctggtgaccgaagatgtgctgaagcatatcaacagtttactctgtagcagggaaatggaagtcagctattttgctgcaggtatcatagcccacctgacatctgacagacagctttggatatcccgtgacttccagaggcgtactcttctccaagatctgcatgcaaccatacagaattggccaagttcaagttgtaagatgacagcattggtgacctatagatctttcaagacatttttcccgctccttggcaacttctctcaaccagaggttcagctctgggcactatgggctatgtatcatgtctgcagtaaaaatcccagcaaatactgcaaaatgttagttgaagaagaaggattgcagcttttgtgtgatatccaggagcacagtgaggcaacccccaaagcacagcagattgcagcctccattctggatgacttcagaatgcatttcatgaattatcagaggcccactctgtgtcaaatgcccttctgaacctaaggaatttcagaggtgtgtgctcttcctcaatgtcaggtgttctgccctggcagtaattgcacatcagttgtcattggagtttgtgagttggctgtctcattggcctttgattgttgattttatatatgttacaaaaggttggatttgtatgatagctgtaatcccaagtcaagttggactcattctgcagcctttcagcagcaattttgaagactcaaaccgtggactctgggaaggcctgggagcttgtgttggaacagctatgcaagttacttttctctagccttggacaattttttccctttgggagcttgtcatgggagtgggacctgttcactagaagagaaaggaaacctacagggagactttgatatttatattaaatttcctttgttgttatcgtcatgtgaagctatgagaaaagcttgggaagcatatgcttcaaaatgtagtgtttagaaggcagaacccctgttggagagcggggaaaagaatttatttatttatttatttatctatggctgggtatggtggctcacgcctgtaatcccagcactttgggaggccaaggcaggtggattgtctgaactcaggagttcgagatcagccttgccaacgtggtaaaactccgtctctaccaaaaaatacaaaaattagctgagcgtggtggtgtgcacctttactcctagctacttggaggctgaggtgggaggaccacttgagcccaggaggcagaggttgcagtgagctgagattgcaccactgcactccagcctggatgacagagtgagacctcatctcaaatgaatagaggggtggagaaaagagaaatatatttttttacctttttttttttttttttttttgtgacggaatctcgctctgtcgcccaggctggagtgcagtggcacaatctcggctcactgcaacctctgcctcccaggttccagcaattctcctgcctcagcctcctgagtagctgggactacaggcacatgccgccacgcccggctaatttttgtattttttagtagagacagggtttcaccatattggtcaggctggtctcgacctcctgacctcgtgatccacccgtctcggcctcccaaagtgctgggattacaggtgtgagtcactgcacctggcctttttacaattttgggtgtctatctttggcatgtttcctgttatgtgagcatgacatgctgtgtatgtgagtgagcttgtagggcgtggtgggacttaggcatttgcagacagtgtttagatgaaagattacatgtaatgataaatctgaatccctccattttatttgggtggaaccatgaccaaaaatggtaggaagacgaaaggccagaaagagactttgccagagagttcacggagttttcttaccccgcatgctgactaaagaaaacatgggcttttctgaaaccagcttcaactacagtataaactatatcagaagcttacttgataagccttgcggagctgctctgaggaatagtgtgaattccttccttgccttattgttgactgttaatgaacatgttttgtcatttatctgtttaagtttttcagaaaataaaagtaaatttctgttagcacattttaggattagatttttgtgcttttggctggcttggttcagattcttaactagagtaccatgtactgtctttggaaatcaaatgaggaagaagctcattctcttactctaaaccatgttccaaactattaccagagtccaaccagataagcagaatttgtaaccttacttccttccatagtccttaaactgtactgtattttttcacactcttgcatgattccaaaaggatatcttcctgacctgggttctagtacctcagagcattgttatcagatgctagcttattctaatgtgaggatgtgttaggggaactagtgtgttaagtccaattctgtacaagacatcctttcaagttctgtgtcattcacaacaatcctcacgggtaggtgagttttattttcctcacttaacagatgagaaaaa

SEQ ID NO: 204876 - DNA, 3682 bp, Homo sapiens
  Payload ID: 20412
  Gene Name: zyg-11 family member A, cell cycle regulator
  Uniprot ID: Q6WRX3
  ENST ID: ENST00000612017
  CDS Start-End: 648-1901
gggaatatcctctcaagccctgaggtgcagggctgggaaggagtgggtgagcggctgggtcgtggcaggttggtctggggaggctggggaggctggggaggcgggaggagaacggttggccccggcagcggcgtgtcggagggcggatggggctaggaggccgcccggggggtggggtctgcggcgggccggcccccgcgtgcgcgtcgcctcgccgggcatttcaaaagctcgccggcagggcgcggcgctagctccgtgtgcctcgcaggcgtggtgggcgcgtcctggcagccgcccgcttggttctcgcgggatccgggctccggctcgacgccggctctctttttgacgccccgccgccggggttgccatggttcatttcttgcacccgggccacacgccccggaacatcgtccctcctgacgctcagaaggatgccctgggctgctgcgtggtacaggaagaggcatctccctacactttggtcaacatctgcctgaatgtcctgattgctaacctggagaaattgtgttctgaaagacctgatggaacactgtgccttccggagcattggagtttccctcaggaagtagccgagcgatttctcagggtgatgacttggcaaggttgctggaggagccagtatgagtcagatttcagaagcactgagccgatacaggaacagatcatgttttgtgaaggaagccctccacaggctgttcacagagacattttcaatggaggtaaccatgcctgctattttaaagcttgtggctataggaatgaggaatcacccattggatttgcgagtgcagttcacagccagtgcttgcgctctcaacctaacacgccagggcctggccaaggggatgcctgttcgcctgttgtcagaggtcacctgtctacttttcaaggctctgaaaaatttcccccattaccagcagttacagaagaattgtcttctctccttaaccaattccaggattcttgtggatgttccatttgacaggtttgatgctgccaagtttgtcatgagatggctctgtaagcatgaaaaccccaagatgcaaacaatggcagtgagtgtcacctctattctggctctgcagctctcacctgagcaaacggcacagcttgaagagcttttcatggcagttaaggaacttctagcaatagtaaaacaaaagactactgagaatttagatgatgtcaccttcttgtttactttgaaagcactttggaatcttacagatgggtctccagctgcctgcaagcacttcattgaaaatcaaggattgcaaatcttcatccaagtcttggagaccttttcagagtcagcaatacaaagcaaagtacttggtcttttgaacaacatagcagaagtcagagagctctcttccaagctggtgaccgaagatgtgctgaagcatatcaacagtttactctgtagcagggaaatggaagtcagctattttgctgcaggtatcatagcccacctgacatctgacagacagctttggatatcccgtgacttccagaggcgtactcttctccaagatctgcatgcaaccatacagaattggccaagttcaagttgtaagatgacagcattggtgacctatagatctttcaagacatttttcccgctccttggcaacttctctcaaccagaggttcagctctgggcactatgggctatgtatcatgtctgcagtaaaaatcccagcaaatactgcaaaatgttagttgaagaagaaggattgcagcttttgtgtgatatccaggagcacagtgaggcaacccccaaagcacagcagattgcagcctccattctggatgacttcagaatgcatttcatgaattatcagaggcccactctgtgtcaaatgcccttctgaacctaaggaatttcagaggtgtgtgctcttcctcaatgtcaggtgttctgccctggcagtaattgcacatcagttgtcattggagtttgtgagttggctgtctcattggcctttgattgttgattttatatatgttacaaaaggttggatttgtatgatagctgtaatcccaagtcaagttggactcattctgcagcctttcagcagcaattttgaagactcaaaccgtggactctgggaaggcctgggagcttgtgttggaacagctatgcaagttacttttctctagccttggacaattttttccctttgggagcttgtcatgggagtgggacctgttcactagaagagaaaggaaacctacagggagactttgatatttatattaaatttcctttgttgttatcgtcatgtgaagctatgagaaaagcttgggaagcatatgcttcaaaatgtagtgtttagaaggcagaacccctgttggagagcggggaaaagaatttatttatttatttatttatctatggctgggtatggtggctcacgcctgtaatcccagcactttgggaggccaaggcaggtggattgtctgaactcaggagttcgagatcagccttgccaacgtggtaaaactccgtctctaccaaaaaatacaaaaattagctgagcgtggtggtgtgcacctttactcctagctacttggaggctgaggtgggaggaccacttgagcccaggaggcagaggttgcagtgagctgagattgcaccactgcactccagcctggatgacagagtgagacctcatctcaaatgaatagaggggtggagaaaagactcgtgatccacccgtctcggcctcccaaagtgctgggattacaggtgtgagtcactgcacctggcctttttacaattttgggtgtctatctttggcatgtttcctgttatgtgagcatgacatgctgtgtatgtgagtgagcttgtagggcgtggtgggacttaggcatttgcagacagtgtttagatgaaagattacatgtaatgataaatctgaatccctccattttatttgggtggaaccatgaccaaaaatggtaggaagacgaaaggccagaaagagactttgccagagagttcacggagttttcttaccccgcatgctgactaaagaaaacatgggcttttctgaaaccagcttcaactacagtataaactatatcagaagcttacttgataagccttgcggagctgctctgaggaatagtgtgaattccttccttgccttattgttgactgttaatgaacatgttttgtcatttatctgtttaagtttttcagaaaataaaagtaaatttctgttagcacattttaggattagatttttgtgcttttggctggcttggttcagattcttaactagagtaccatgtactgtctttggaaatcaaatgaggaagaagctcattctcttactctaaaccatgttccaaactattaccagagtccaaccagataagcagaatttgtaaccttacttccttccatagtccttaaactgtactgtattttttcacactcttgcatgattccaaaaggatatcttcctgacctgggttctagtacctcagagcattgttatcagatgctagcttattctaatgtgaggatgtgttaggggaactagtgtgttaagtccaattctgtacaagacatcctttcaagttctgtgtcattcacaacaatcctcacgggtaggtgagttttattttcctcacttaacagatg

SEQ ID NO: 204877 - DNA, 8093 bp, Homo sapiens
  Payload ID: 20413
  Gene Name: zyg-11 family member B, cell cycle regulator
  Uniprot ID: Q9C0D3
  ENST ID: ENST00000294353
  CDS Start-End: 146-2380
tacgctcctagcttgagggaaagaggccgaggcctgggccaagcccggagccgccgctcgccggagcctcctggagcctccgcgccggctcagcctgggggcgggctccggtccggcccgccgccgcacccaggacggaggctgcatgcccgaggaccaggccggcgcagccatggaggaggcgtctccctattccttacttgatatctgcttgaatttcttgactactcaccttgagaagttctgttcagccagacaagatggaacattgtgtctgcaggaacctggagtattcccacaggaggtggctgatcgactgcttcggaccatggcttttcatggtctattgaatgatggaactgtgggtatttttaggggcaaccagatgcgcttaaagcgagcctgcattcgcaaagcaaagatctctgctgttgctttccggaaagctttctgccaccacaagttagtggaacttgatgccacaggtgtgaatgctgatatcacgattacagacattatcagtgggcttggcagtaacaaatggatccagcagaatctccagtgcctggtgctgaattcattaactctctccctcgaggatccttacgagcgctgcttcagccggctttctggccttcgagctttaagcatcacgaatgttctcttttacaatgaagacctggctgaagttgcctcattgccaagattagagagcttggatatttctaacacctcaatcacagacatcactgctctactggcctgcaaagaccgactcaagtctctaaccatgcaccacttgaaatgtttaaaaatgacaactacccagatactggatgtagttcgggaactcaaacatctgaatcatcttgatatctcagatgataaacagtttacatcagacatagctcttcgcttactagaacaaaaagacatcctacctaaccttgtttctctggatgtttctgggagaaagcacgtgacagataaagccgttgaagcctttatacaacaacgtccaagcatgcaatttgtaggtttgctggctactgatgctggttactctgaattcctcacaggcgaaggacatttgaaggtgtctggggaagccaatgaaactcagattgcagaagcactgaagcgttacagtgaacgggcattctttgttcgggaagctctatttcatctttttagtctgactcatgtgatggaaaaaacaaagccagaaattttaaagcttgtggttactgggatgagaaaccaccctatgaatttgccagtgcaactggctgcaagcgcctgtgtatttaacttaaccaagcaggatcttgctgcagggatgcctgtccgactcctggctgatgtgacccatttgctgctcaaagccatggaacattttcccaatcaccagcagttacagaagaattgcctcctttcactttgcagtgaccggatccttcaagatgttccatttaacaggtttgaagcagccaagcttgtcatgcagtggctttgcaaccatgaggatcaaaacatgcaaaggatggcagttgctatcatttctatcctggctgccaagctttctacagaacaaactgcacagcttggtactgagctcttcattgtcaggcaacttcttcaaatagtgaagcagaaaaccaatcaaaattcagtggacactacattgaaatttactttgagtgcactttggaacctcacagatgaatctccaaccacttgtagacactttattgaaaaccaagggttagaactcttcatgagggttctagagtctttcccaactgagtcatccattcagcagaaagttctaggacttttgaacaatatagctgaagtacaagaattacattctgaattaatgtggaaagattttatagaccacatcagtagtctcctacacagtgtggaagtggaagtcagttactttgcagctggaattattgcccatttaatatccagaggtgaacaagcttggacattgagtcgtagccagaggaattctctgctggatgatttgcattcagctattttgaaatggccaactccagagtgtgagatggtagcatacaggtcctttaatccatttttcccattacttggctgtttcacaacaccaggagttcagctatgggcagtttgggccatgcaacatgtctgcagcaagaatccttcaaggtattgcagcatgctgattgaagaaggaggattgcagcatttatacaacatcaaagatcatgaacatactgatccccatgtccaacagattgctgtggccattctggatagcttagaaaaacacattgtgcgccatgggaggccacctccctgtaaaaaacagccccaagccagactaaattgatagccataagtattggatagttgaatcacaggaatcctttttgtgattggtccatttggaatatcttaccctccctgatgttttgggggtttctatgacaagagtcataaaatcagtttgggattgataatgtgtagtactgcccatgtgaacagtctctaatttgtcttgtgattttaaacttatgagtcaagaagggtctcttcctttatcattgccttttaggaaattttccacatctttcagtgtttgaacttacttgtgcttgagattctacagttttatggtaaagtttgcacgaacccttaggccagacttttctgatctcagagtcccttccaatcaatttgcagcttcacataagctgttgacctgatttctgacactgcttcagttgtaaattttatactgcttctgtataaaatgcctttcttctctatctgtgtatattttataagatgtccttcttagtgtgaaagaagggaaatgtggatcatcttgtggaagctaatcactggcaggagcctggatggctggcggaaagatatatgagaaagaaaaattatgaaggtagaacagagtgtaggaactgggaattggtttcatggtataggttttaaaatgagacaggctacccttcgggagtccacctctcttgaggcggtgagcagaagcttgtcctccatatttatacctagaagtgtggactgctggttcctgcacagactgccggttattcactaggaatatttccccaagcaccacagtataaaatactacagcactctgtgttaaagactaactgtctacatctccatatgttgtagtgttgtgaaaatgtgattttaaaaaattatcgccagttaaaactggctattcttttcctctatttcaaagtcatttttgttcagtggaatagagacagcaacatggtgttaacctctcaattaaaatacaattgacaccagtaaattttgccataaaaagttaaaatctcttgttcaaaatatgtgtatcttcttaatgtgttcatgttagagaaagtgtccccatctcactgccaaaaatgaaagaaaataattaaactctttaaatgattaaatgtaatgattctactcgcagtgcataacagcacatatttttgacagattattttttaggcaattacctttccttaaggtatctgatacagtatagtaaagaatcacttatatcagtaatagcacttgagagatagcaagtcaccaagaaacttaattttcatttaaaattttattttgtgaataaggtcaatctacaatcccagataactacattttttttcatagatggccagtgttttcaacagagatttaaaatggaatattaaaattatagtgattattcagaagcattttaatttagaaaggagctggtttgttagttcactgatgacattttttgacaaacattttataccattatcacaataatcagacttgaattttttttggagttccttcatgtgaatgaaaactgagttaaaagaaagtaggcatttaggtctggatgcagtggctcatgcttgtaatcccagcactttgggaagctgaagcaggaggattgcttgagcccagaagttcaagactagcctgggcaacatagtgagactcggtctctaccaaaaaaaaaaattttttttttttaaattagctgggtgtggtggcacctgggaaacagagcgagacgctgactcaaataaatatctaaatagatatttagaatcactgaaaaccatattaaatgctgggttaatgctgacttaattggcttaaggaatttttataggcgtaagataaattttcacagactaagtttatttcagacaaaatagagaattcttttaaaagttttttttttttttttcctttttcgaatgttaatgtctaagacaaagttcagaaaacgagatggcctgtggtagtttggaaattgctagatatgttgaccgtttccaggtcttttatctagtgtagttaagggaaagcctatttaagaagtttggcttcaagtttctgttttataagacaaaagtgcatatttctttacaggctaatgctaggtttttgtctttacaaattattttcagaaatggctaaaagtgtacagaaaacagtaaatcccttctttactcagaataacttcttaatagttgaagcatccaaaatatgtaaaagcaagggtgggcgtagtggctcttgcctgtaatcccagcattctgggaggccgaggcgggcagatcacttgagatcaggagttcgagaccaccctggccaacgtggtgaaaccccgtctctactaaaaatacaaaaactagctgggcatggtggcttttttgcacgcctatagtcccagctactcgggaggctgaggcacgagaatcacttgaacccaggaagtggaggttgcagtgagctaagatcgtgccactgcactccagcctggacaacggagtgagactctggggaaaaaaaaaattaaacttcctactttttttctttttgtagagacagagtttcactctgtcgcccaagctggagtgcagtggcacaatcatacctcactgcagcctcttgggcttatgtgatcttaccccctcagcctctggagtagctggaactacaggctaaatttcctactttgtaaacatcagtagtggccagatacttctgagtcttaaaagcataataggccgggcgcggtggctcacgcctgtaatcccagcactttgggaggccgaggtgggtggatcacaaggtcaggagttcaagaccagcctggcccaaatggtgaaaccctgtctctactaaatatacaaaaattagctgggtgtggtggcgggcacctgtaatcccagctactcaggaggctgaggcaggagaatcgcttgaacctgggaggtggaggttgtggtgagccaatatcatgccactgcactccagcctgggtgacagagtaagactccgtctcaaaaaaaaaaaaagcataataatttattacatcccaaatatataaaaatttgagtgcctttgcagttgggatggttcctaaaattgcgtatagaattaaggcacagaattgtgtgtaaggtcctgaatctggctaaaatacagtggatgtatgtattggaattatgaggcataagtagccagtatctatagttagaatctacaaggcctcctttttgcacctgtagactagaatataactgttattggtgcctttgagtgttatctctcagtggctagaggtgctgtttcaagcacaatttagactagggttgaaccactcattgttcaaatcattggtgggctccaatgtaaaatatcactacatcagtccacaagcaacattaaggaaatctaaaggaaatggaatttgactttttagagtataatgatgttctagggcataatgaggaaaatttttaaaaaatagattataatgatacatattggtatcattaagacaacagatttgagcaaatacaattaaggtgtcttattttttgcatcaagtaattattgctgtggtctttctactccacaaaataattttttctttttgcagttgaaaattaactgcattattaactaattaataaaataaatcaagtggtataagggattagtttaccctcaagccgatgactccatggctactgatattagttagtttaggatttttaaaaagcatatcagacccccagtttcaggaattgagtataaatattgcttcttgtcaccctgggacagtaatgccttatagtggcactagtcaccttaagtagattacacatggttgaggtgaataaagctgcatgggaatttgctttcgtgatatatttcatttgcaaacttctacataatcaagttttatgtttaaaaccatcggttctatatatctagctttaggaagttgcccttacaggtgggaccttttgtgttaatctgttttctccccagtcatcttatttggctatgttaaaaaaaaaaaaaaaaaaaaagcgagagagagagatggtgtctcactgtgttgcccaggctggtctcgaactcctggcctcaagtgactttcccacctcagcttcccaaagtgctggaatcacaggcatgagccacagtgcctggtcttagctgtgtttttaattatgccatgcatcaacataacaccgggccatcttcctatcccttcctatcccatatgtttaatgaaaacatattttatgtgctaaattaggttaatttaccagagatttagcttagtgtttttaaactatagaacaatacccctatagaacaatgtacagctgcacccaaggttaaaaagaggtagcagggaaaacaaacttaaactctttgtatatggtgaaacccatccctctcctgccctctaatggtatgtttacattatttcgttattatacaatgtagtggtataaacagtattattaaactgaaggcataagttaaaggaagtatgttactttgagctgatgtaggctcttccacttttatctgtattttacttatttggggactttgtattgctagggcttcagaatactaactttgacacagctcccagagaggtttgcaaacttttggtttccctctcaaatccatggtagtagtttcaaatgagtttgtggataatggatgtttagtccttatcatttgctgtgttttgacagtttttaatttgcagtattcactcacgaactgttttattttaggaataatgcaaaaccaaccttcgtccggtgatgagaatagccgtatgataagagaatttgctcatcgtgctttaaatgattaactgttttaccttatttagtatttcatagactttgcatgatatggtacactcctaattatgcattctttggtttccaaatcttaatctaagatactttgttaactgactggtagcctaagaaagagacttttcttcctgtttttctctctccccattttttggggtaagttttgcaaagatcagtgctgcttctcatgactctaaagtaaagctcttttggatagcacagcctaactttacagctagacagaatggccattaagaatatttccaaaatccaagtttatcaaaattattttgtgggaaatcatcaatctattttattaatgttatgtgtttaattttggacttattttgggaaaaactgttcaaattgggtccttttaagcttattttaagcagcctagaaggaagaagctacttagctaatgaaagctgagacactttattaaaagcaggatcttaagagcattgtttttccttaaaaactttatactctcagataatctgcaacaacaaaaattaagaaatccctgacttttgtagaattcccactgtcaaattctcactgacttatgagtgtgagagaagttatcttttgtttgaattctgatagaacagtttaactcctttctaaggatataaaaaattcattggaaagtgtgtatatttcaaagactctcaattatctggactgaaggcactgttctcactatggccagatgaatgggagtattctgtacatgaatcatgctgtattttaaatcaggacatcacttaagtattaatgttgtgtgtacagatttttgttttgggattttttttgcctaaataaatgttataaattttatgtaaa

SEQ ID NO: 204878 - DNA, 2294 bp, Homo sapiens
  Payload ID: 20413
  Gene Name: zyg-11 family member B, cell cycle regulator
  ENST ID: ENST00000545132
  CDS Start-End: 188-1888
ggttcgggctgcggctgcggctgcggctgcggctgctactgctacgctcctagcttgagggaaagaggccgaggcctgggccaagcccggagccgccgctcgccggagcctcctggagcctccgcgccggctcagcctgggggcgggctccggtccggcccgccgccgcacccaggacggaggctgcatgcccgaggaccaggccggcgcagccatggaggaggcgtctccctattccttacttgatatctgcttgaatttcttgactactcaccttgagaagttctgttcagccagacaagatggaacattgtgtctgcaggaacctggagtattcccacaggaggtggctgatcgactgcttcggaccatggcttttcatggtctattgaatgatggaactgtgggtatttttaggggcaaccagatgcgcttaaagcgagcctgcattcgcaaagcaaagatctctgctgttgctttccggaaagctttctgccaccacaagttagtggaacttgatgccacaggtgtgaatgctgatatcacgattacagacattatcagtgggcttggcagtaacaaatggatccagcagaatctccagtgcctggtgctgaattcattaactctctccctcgaggatccttacgagcgctgcttcagccggctttctggccttcgagctttaagcatcacgaatgttctcttttacaatgaagacctggctgaagttgcctcattgccaagattagagagcttggatatttctaacacctcaatcacagacatcactgctctactggcctgcaaagaccgactcaagtctctaaccatgcaccacttgaaatgtttaaaaatgacaactacccagatactggatgtagttcgggaactcaaacatctgaatcatcttgatatctcagatgataaacagtttacatcagacatagctcttcgcttactagaacaaaaagacatcctacctaaccttgtttctctggatgtttctgggagaaagcacgtgacagataaagccgttgaagcctttatacaacaacgtccaagcatgcaatttgtaggtttgctggctactgatgctggttactctgaattcctcacaggcgaaggacatttgaaggtgtctggggaagccaatgaaactcagattgcagaagcactgaagcgttacagtgaacgggcattctttgttcgggaagctctatttcatctttttagtctgactcatgtgatggaaaaaacaaagccagaaattttaaagcttgtggttactgggatgagaaaccaccctatgaatttgccagtgcaactggctgcaagcgcctgtgtatttaacttaaccaagcaggatcttgctgcagggatgcctgtccgactcctggctgatgtgacccatttgctgctcaaagccatggaacattttcccaatcaccagcagttacagaagaattgcctcctttcactttgcagtgaccggatccttcaagatgttccatttaacaggtttgaagcagccaagcttgtcatgcagtggctttgcaaccatgaggatcaaaacatgcaaaggatggcagttgctatcatttctatcctggctgccaagctttctacagaacaaactgcacagcttggtactgagctcttcattgtcaggcaacttcttcaaatagtgaagcagaaaaccaatcaaaattcagtggacactacattgaaatttactttgagtgcactttggaacctcacagatgaatctccaaccacttgtagacactttattgaaaaccaagggttagaactcttcatgagggttctagagtctttcccaactgagtcatccattcagcagaaagttctaggacttttgggttaatatgattatttgatacagaagttggctcaggtcatctgaaacggaaagaacaatatagctgaagtacaagaattacattctgaattaatgtggaaagattttatagaccacatcagtagtctcctacacagtgtggaagtggaagtcagttactttgcagctggaattattgcccatttaatatccagaggtgaacaagcttggacattgagtcgtagccagaggaattctctgctggatgatttgcattcagctattttgaaatggccaactccagagtgtgagatggtagcatacaggtcctttaatccatttttcccattacttggctgtttcacaacaccaggagttcagctatgggcagtttgggccatgcaacatgtctgcagcaagaatcgtatgtacc

SEQ ID NO: 204879 - DNA, 4259 bp, Homo sapiens
  Payload ID: 20414
  Gene Name: zyg-11 related, cell cycle regulator
  Uniprot ID: Q7Z7L7
  ENST ID: ENST00000291900
  CDS Start-End: 408-2708
ggctccgagccgtaggagccggatcgggggaggggccgggcccaggagcctcagccccgccggcagccctaagggcaaggtaaccgccacggggtccccgtcgcgaccccctccctcccggagctcccgtccccgggatcccaagctccgccccgccgacccccgtctcccctggaccccggctctagcctgacgagatccccaacctcctgaggtgctctggccccggattctcccgggctgcattctctgctcctcctcgcctgcgaagcatcacgtccgcttcccgacgctgagggcagccccgtccagggcagtggctctgccaatgatcctgtgagtattcaggaatcactgttgcccctggggatccttgtcctggagtggcccacctgcttgcccccagcatggcgtccgacactcccgagtcgctgatggccctctgtactgacttctgcttgcgcaacctggatggcaccctgggctacctgctggacaaggagaccctgcggctacatccggacatcttcttgcccagcgagatctgtgaccggctcgtcaatgagtatgtggagctggtgaacgctgcctgtaacttcgagccacacgagagcttcttcagcctcttttcggacccccgcagcacccgcctcacgcggatccacctccgtgaggacctggtgcaggaccaggacctggaggccatccgcaagcaggacctggtggagctgtacctgactaactgcgagaagctgtccgccaagagcctgcagacactgaggagcttcagccacaccctggtgtccttgagcctcttcggctgtacaaacattttctatgaggaggagaacccagggggctgtgaagatgagtacctcgtcaaccccacctgccaggtgctggttaaggatttcaccttcgagggcttcagccgcctccgcttcctcaacttgggccgcatgattgattgggtccctgtggagtccctgctgcggccgcttaactccctggctgccttggacctctcaggcattcagacgagcgacgccgccttcctcacccagtggaaagacagcctggtgtccctcgtcctctacaacatggacctgtccgacgaccacatccgggtcatcgtgcagctgcacaagctgcgacacctggacatctcccgagaccgcctctccagctactacaagttcaagctgactcgggaggtgctgagcctctttgtgcagaagctggggaacctaatgtccctggacatctctggccacatgatcctagagaactgcagcatctccaagatggaagaggaagcggggcagaccagcattgagccttccaagagcagcatcatacctttccgggctctgaagaggccgctgcagttcctcgggctctttgagaactctctgtgccgcctcacgcacattccagcctacaaagtaagtggtgacaaaaacgaagagcaggtgctgaatgccatcgaggcctacacggagcaccggcctgagatcacctcgcgggccatcaacttgctttttgacatcgcccgcatcgagcgttgcaaccagctgctgcgggccctgaagctggtcatcacggccctcaagtgccacaaatatgacaggaacattcaagtgacaggcagcgccgctctcttctacctaacaaattccgagtaccgctcagagcagagtgtgaagctgcgccggcaggttatccaggtggtgctgaatggcatggaatcctaccaggaggtgacggtgcagcggaactgctgcctgacgctctgcaacttcagcatccccgaggagctggaattccagtaccgccgggtcaacgagctcctgctcagcatcctcaaccccacgcggcaggacgagtctatccagcggatcgccgtgcacctgtgcaatgccctggtctgccaggtagacaacgaccacaaggaggccgtgggcaagatgggctttgtcgtgaccatgctgaagctgattcagaagaagctgctggacaagacatgtgaccaggtcatggagttctcctggagtgccctgtggaacatcacagatgaaactcctgacaactgcgagatgttcctcaatttcaacggcatgaagctcttcctggactgcctgaaggaattcccagagaagcaggaactgcataggaatatgctaggacttttggggaatgtggcagaagtgaaggagctgaggcctcaactaatgacttcccagttcatcagcgtcttcagcaacctgttggagagcaaggccgatgggatcgaggtttcctacaatgcctgcggcgtcctctcccacatcatgtttgatggacccgaggcctggggcgtctgtgagccccagcgtgaggaggtggaggaacgcatgtgggctgccatccagagctgggacataaactctcggagaaacatcaattacaggtcatttgaaccaattctccgcctccttccccagggaatctctcctgtcagccagcactgggcaacctgggccctgtataacctcgtgtctgtctacccggacaagtactgccctctgctgatcaaagaaggggggatgccccttctgagggacataattaagatggcgaccgcacggcaggagaccaaggaaatggcccgcaaggtgattgagcactgcagtaactttaaagaggagaacatggacacgtctagatagaggcctccgtccccatggccgccaccgctctggaccacaggcggggaggaagcatgctcaagcagcccagcgggcgggccccttccgagggagcctcccacggagtgaagagacatgggggacttttgcacaaccgacgcttttccttaatgttagtgagatatatatatattatatatatatattttttttttggttaggaagtgtgaagttttgtgtgtatgatttctgtgcaaaaacaaaagcaacactcctgagtccttgcagcttccttggccattctcaaacccactcagccttcatcgctgacacacacactcctaccccaaccagactaaatgcctataacgctgtgagtgtccagtccttgtccaggaaactcagatcccggcctggcttcctttcatgagaggagcaggccttggacagcgtatcgagcatcctgacccactgcccctgcctgagaacgccatctcggctcccgggcacagctgatggggtttggggattagaacttaccccactgggtctcccaaaagccttggtgctcccggctgtgggccatctggggcaggaaagtgagccattcctaggctgaggtccaggcagccctgcccctgaagaccctctaggagcagggcacccagtggccctgctgctgtccagccaggcctgcctgaggccacgctgctatggaggctgcctcctagtctcccaccaggtcccaggctgtggaaagccccagcccagggatggtcagaactcaggggcagattccactgccccttctgccaaacacatccagaacctgccctcagccctggaagctagcatcttctggggccaggggcttgcttcctcgctccatagccctcaactgcccaggcgctcccaccagcagaactgagcctgcctcctcctcccagcctgccccgctgcccagaggaccccacgcctctcagaggcagaggtcccatgacagcctttgacccacaacggccacacagccgcctccagaccagcactcggactgccctgcagtggccgcttgggcctccctggcggtcccgccctgccctaggctttaccttggaagcctgagaggcgccggctctcttgctcctccatcgatggacactgcattgcttctcatcggacacttgtggagcgcaggggcctggggagcagcgctaaccctggaggcagcctttgggtgatggctttttcttcccttttcctcccgcgggcctgttttcaggtgttcctagcatttctgcctccaggcaggacggcaggggtgagcagctttgggagagacacctggcctttttctcctggagcctctccctcccggccctgggaagtgggcgcagccctgtgttcccccagcttggcagatgggctgcatgcggcgctcccttccttcccacgctcagcggccccggccagaccctggcagacttcacacctcattgctttaccccctggggcctggggaaatgtctgtactttgggaagtcacagaaatacatttttgtgcaaaatggaaaa

SEQ ID NO: 204880 - DNA, 460 bp, Homo sapiens
  Payload ID: 20414
  Gene Name: zyg-11 related, cell cycle regulator
  ENST ID: ENST00000427848
  CDS Start-End: 158-460
aggtcgccgcccaatttcccatttggaagctcggttgcctggtggcgcatgccctagatggaggcagtggctctgccaatgatcctgtgagtattcaggaatcactgttgcccctggggatccttgtcctggagtggcccacctgcttgcccccagcatggcgtccgacactcccgagtcgctgatggccctctgtactgacttctgcttgcgcaacctggatggcaccctgggctacctgctggacaaggagaccctgcggctacatccggacatcttcttgcccagcgagatctgtgaccggctcgtcaatgagtatgtggagctggtgaacgctgcctgtaacttcgagccacacgagagcttcttcagcctcttttcggacccccgcagcacccgcctcacgcggatccacctccgtgaggacctggtgcaggaccaggacctggaggccatccgc

SEQ ID NO: 204881 - DNA, 715 bp, Homo sapiens
  Payload ID: 20414
  Gene Name: zyg-11 related, cell cycle regulator
  ENST ID: ENST00000414921
  CDS Start-End: 222-715
aagtgacgcgccccgggtttgttgacagcggaggcggcggcggctgcaggctccgagccgtaggagccggatcgggggaggggccgggcccaggagcctcagccccgccggcagccctaagggcaaggcagtggctctgccaatgatcctgtgagtattcaggaatcactgttgcccctggggatccttgtcctggagtggcccacctgcttgcccccagcatggcgtccgacactcccgagtcgctgatggccctctgtactgacttctgcttgcgcaacctggatggcaccctgggctacctgctggacaaggagaccctgcggctacatccggacatcttcttgcccagcgagatctgtgaccggctcgtcaatgagtatgtggagctggtgaacgctgcctgtaacttcgagccacacgagagcttcttcagcctcttttcggacccccgcagcacccgcctcacgcggatccacctccgtgaggacctggtgcaggaccaggacctggaggccatccgcaagcaggacctggtggagctgtacctgactaactgcgagaagctgtccgccaagagcctgcagacactgaggagcttcagccacaccctggtgtccttgagcctcttcggctgtacaaacattttctatgaggaggagaacccagggggctgtgaagatgagtacctcgtcaaccccacctgccaggtgct

SEQ ID NO: 204882 - DNA, 1460 bp, Homo sapiens
  Payload ID: 20415
  Gene Name: zygote arrest 1
  Uniprot ID: Q86SH2
  ENST ID: ENST00000327939
  CDS Start-End: 41-1315
gcctatttagggtgcggcggcgggcgggagcagtgcgcccatggcggccctgggggacgaggtgctggacggttacgtgttcccggcgtgccccccctgctcgtaccggtacccataccccgcggccaccaagggcaagggcgcggcgggcggcagctggcagcagcgcggcaggggctgccttcccgcctcctccccctgctcggcgggcgcggcctcgttgtccttcccgggctgcgggcggctgacggccgccgagtacttcgacagctaccagcgggagcggctcatggctctcctggcgcaggtggggccgggtctcgggccgcgcgcccgcagggccggcagctgcgacgtggcggtgcaggtgagcccgcgcatcgacgccgcggtacagtgctcgctggggaggcgcacgctgcagcgccgggcccgcgaccccgagtccccggccggccccggggccgagggcaccacgggtggcggctctttctcccagcagccatcccgtcgaggcctggagcagggcagcccccagaacggcgccccgcggcccatgcgcttcccgcgcaccgtcgccgtgtactcgcccctggccttgcgccgtctcaccgccttcctggaggggcccgggcccgcggcgggcgagcagaggtccggggcgtcggacggagagagggggccgccgcccgcgcggcttcaaggcccagaggagggggaggtgtggacgaagaaggcgccccggcggccgcagtccgacgacgacggcgaggcccaggccgcagtccgagcgagctgggagcagccggccgacggtcccgagctgccgccgcgagaggcccaggagggcgaggcggctccgcggtcggcgctaaggagcccggggcaacctccgtcggcggggagggcccgagacggcggcgacggacgggaggcggccgtcgcgggagaggggccgtcgccacggagcccggagctgggcaaggagcggctgcgcttccagttcttagagcagaaatatggctattaccactgcaaggactgcaacatccgctgggagagtgcttatgtgtggtgtgtacagggaactaacaaggtttacttcaaacagttttgcagaacttgtcagaagtcttataacccttaccgagtggaggatatcacctgtcaaagttgtaaacaaacgagatgttcctgcccagtaaaacttcgccacgtggaccctaaacggccccaccgtcaagatttgtgcggtagatgcaaaggcaaacgcctgtcctgtgacagcactttcagcttcaaatacatcatttaggtgaaagtcagtgttgctgtgcatgcgctgatggagtagacgagtgagcttttccgtgcctctcctccacctctcccttctcaaaatacttcatgaaaggcagtgtattctgaaaaagccttcaaataaaggtattgcaacacga

SEQ ID NO: 204883 - DNA, 1103 bp, Homo sapiens
  Payload ID: 20416
  Gene Name: zygote arrest 1-like
  Uniprot ID: A6NP61
  ENST ID: ENST00000345108
  CDS Start-End: 30-995
ttagactgcgcctgagcacctgagagcggatggagcgctttgtccgtgttccctatggcttgtaccagggttatgggagcacagtgcctttgggccagcctggactctcagggcacaaacagcccgactggaggcaaaatatgggtcctcccacttttctggccaggccagggctgctggtgcccgcgaacgcccctgactactgcattgacccttacaagagggcgcagcttaaggccattctctcccagatgaaccccagcctgagcccgcggctgtgcaagcccaacaccaaggaggtgggcgtgcaggtgagcccgcgggtggacaaggctgtgcagtgctctctggggcctcgcaccctcagcagctgctccccctgggacggcagagacccccaggagcccctgccagcctgtggggtcacttcgcccgccaccggccgcaggggcttgatccgcctgcggagagatggggacgaagcggagagcaaggcgctcccgggccctgcggaggccagccagccgcagccaccatcacggaggtcaggagctgacaggcaggaggagcccgggcagctggaggaatcgggggagaaagacgccccgtgccctcaggagacgaagagcaagcaggtgcctggagacgccgcctccgagccgctccggaggcccaacttccagtttttggaaccaaaatatggctatttccactgtaaagattgtaagaccaggtgggagagtgcttacgtgtggtgcatttctggaacgaacaaggtttatttcaaacaactctgttgtaaatgccaaaagagttttaacccttatcgagtagaagcaatccaatgtcagacctgctcaaagtctcattgttcctgtcctcaaaagaagagacacattgatctaaggaggcctcatcgacaggaactgtgtggtcgctgcaaagacaagagattctcctgtggcaatatttacagctttaaatatgtgatgtgacttgtacagtgtgacttgtaatggacccctgagctcttcttgtaacttactgtgctgtcttccttttttgcaacttggctctgacctggcatcggaaaatggctaggc

SEQ ID NO: 204884 - DNA, 1564 bp, Homo sapiens
  Payload ID: 20416
  Gene Name: zygote arrest 1-like
  Uniprot ID: A6NP61
  ENST ID: ENST00000533490
  CDS Start-End: 420-1385
agtatctgaccgaataaagcgggagctggagattcggatcacctgtcttcctcgcaggctgaactggaagacctgacttcatctccgaattcgttggttctgtaacatgcctaatacaaggctgaatagggtttgttgtaagacctacaaaaccttcaaatggattcagtgagagttgctcccatgggggccttgctgcttccagaaggtgcttgagcagtaaacagaagcaaccttggattaggaaaaggggtaataagcagcagctcccattagaatctgaaataaatggagaagccaggaatgaatctgaaccaacctgatgaagagaaagaaggggcggatgaaggaggaaggcaaaataaggacccaaacaaactggctaggatattagactgcgcctgagcacctgagagcggatggagcgctttgtccgtgttccctatggcttgtaccagggttatgggagcacagtgcctttgggccagcctggactctcagggcacaaacagcccgactggaggcaaaatatgggtcctcccacttttctggccaggccagggctgctggtgcccgcgaacgcccctgactactgcattgacccttacaagagggcgcagcttaaggccattctctcccagatgaaccccagcctgagcccgcggctgtgcaagcccaacaccaaggaggtgggcgtgcaggtgagcccgcgggtggacaaggctgtgcagtgctctctggggcctcgcaccctcagcagctgctccccctgggacggcagagacccccaggagcccctgccagcctgtggggtcacttcgcccgccaccggccgcaggggcttgatccgcctgcggagagatggggacgaagcggagagcaaggcgctcccgggccctgcggaggccagccagccgcagccaccatcacggaggtcaggagctgacaggcaggaggagcccgggcagctggaggaatcgggggagaaagacgccccgtgccctcaggagacgaagagcaagcaggtgcctggagacgccgcctccgagccgctccggaggcccaacttccagtttttggaaccaaaatatggctatttccactgtaaagattgtaagaccaggtgggagagtgcttacgtgtggtgcatttctggaacgaacaaggtttatttcaaacaactctgttgtaaatgccaaaagagttttaacccttatcgagtagaagcaatccaatgtcagacctgctcaaagtctcattgttcctgtcctcaaaagaagagacacattgatctaaggaggcctcatcgacaggaactgtgtggtcgctgcaaagacaagagattctcctgtggcaatatttacagctttaaatatgtgatgtgacttgtacagtgtgacttgtaatggacccctgagctcttcttgtaacttactgtgctgtcttccttttttgcaacttggctctgacctggcatcggaaaatggctaggcttttgtactttttgtagattgtgtaacaattgtacaatgtgaatagaataaaataaatgcatgtgaactag

SEQ ID NO: 204885 - DNA, 3132 bp, Homo sapiens
  Payload ID: 20417
  Gene Name: zymogen granule protein 16
  Uniprot ID: O60844
  ENST ID: ENST00000400752
  CDS Start-End: 75-578
agggcttggacctggtataaaacatctggaagtttccagggggctgctttgcatctgaaactgtcagccccagaatgttgacagtcgctctcctagcccttctctgtgcctcagcctctggcaatgccattcaggccaggtcttcctcctatagtggagagtatggaggtggtggtggaaagcgattctctcattctggcaaccagttggacggccccatcaccgccctccgggtccgagtcaacacatactacatcgtaggtcttcaggtgcgctatggcaaggtgtggagcgactatgtgggtggtcgcaacggagacctggaggagatctttctgcaccctggggaatcagtgatccaggtttctgggaagtacaagtggtacctgaagaagctggtatttgtgacagacaagggccgctatctgtcttttgggaaagacagtggcacaagtttcaatgccgtccccttgcaccccaacaccgtgctccgcttcatcagtggccggtctggttctctcatcgatgccattggcctgcactgggatgtttaccccagtagctgcagcagatgctgagcctcctctccttggcaggggcactgtgatgaggagtaagaactcccttatcactaacccccatccaaatggctcaataaaaaaaatatggttaaggctagtctgtgtgggggcatctgtggctgggatatctgcctcctgacttagccggggacgtgcaaatctcacttctggctggctttggacatctgtctggaagatgggaagatgagggagaggtatgtaagaatcctgggctttgtgctataatttatcaagaggagatgagattctggcttgcatcaacgctcttcaaggacagctccttggaacattgatccaaactggagtcatgggtctgagggcaaggcctagttgtggcttacaccaaaaccccagatgtcccactctccagctctcctcacccctggtcctccccttgagaaagtggtgaactcacttgctgtgtgtgggtggccaggaccattagcctttgttctttcccagaacccacctgactcctgaaacttagctgaagtctgtgcccgaggaccctgccctgttaccaggcccagttcctcctcacctctacccatgagccccggtgtcctgctaagccctctcagatctgggattcctccttcctcaggaagccaccaccttctcagcagtggaaaccctgcccacactatgctcttaggctttagccatcagaaggttacagtggactgcgggaggctgacactaggctgaactcattaaggaatgaatgggaggtgagaagacacaggcagcaagaatcgagtgtttcaagaagtttggctgtggtttgccagaaataggcaagtcagttttcgggggtgtaaggaaaaagggttttgtgtctttttaaaatcctagacaggagagtcacaagcatgttcacatgataaagaggaagaaagagaaagaggctggagattctgaaaagagatcactggtgaggtctcaaaagagatagaagaggatggttatgtagttggggaaagaaattttaagaagggaagaaaattaaaatgagtgaaggtatacgttagttttgtaaaagttatcaatatctggctgggcacagtgctcacacctgtaatcccagcactttgggaggccaaggcaggcagatcatttgaggtcaggagttggagacaagcctccaacatggtaaaaccctgtctctactaaaaatacaaaaattagccaggtgtggtggcagtcacctgtaatcccagctacttgggaggctgaggcatgagaatcacttgaatgctggaggcagaggttacaatgagttgagacagcacaactgcaccccagcctggatgacagagtgagactccatctaaaaaaaaaaggaatgttatcagtatcaaaatggagtaacatatgtcacatcctaacaaaatggaaccaacctgacacctaaattaagcattgcacctgataacaccatggaggactgggtggagaatcagcagacaatggcagggagaggcagtctgtggaccaagttcaggtgaaaggatcacccatcatgttgggcatcagatcaggcaggttcacacactacctgaggaagctggtctttgtgacagacaagagctgctctgcctcttgggaaacacaggcaccagttttagtgccatcttcttgcacccaaatgctgtcctttaactcatcagttacagtgctggatccctcatcactgccaatacggggctagcaatatgtctgccccagtgaatgcagccgccacggagccccagcctcctctatggcaggggccctgtggtggggaatgaggacttctctatcattaacctccatgcagttggctcaagaaaaggatatggtagttgggcaagggggctcacacctgtaatcccagcacacttgtaatcccaggagggtcgcttgagcccaggagtttaaggccagcccgggcaacatagcaacctgtttgtaggcaaaatgaggagttgaagttccccgtaggatcttctagggctcaaccagccttcatgtgcagtgggactggcaagaaatctgtcatccctgttaccactttgaaggtctcagtgtgtatgcaggtcctgaaaagttcaagtcccacctgaaacgcaacacagcatcatgctctgattcatcagtgattccctaatcaatgccattggcttgcattgggactatctatcccagcctatccagtgacttcagcagctgcagagccccagcctcttctttggcaggggcactgtggtgaggaggaaggattcccttatcacaaatctccatccaattggttctataaacagatatggtggcccaactgttgcgggaagtcagggaccccgaacggagggactggctggagccacagctgaggaacataaattgtgaagatttcatggacatttaccagttcccaaaattaatacttttatactttcttatgcctgtctttactgcaatcactaaacataaattgtgaagatttcatgaacatttatcagttcccaaataatactcttataatttctta

SEQ ID NO: 204886 - DNA, 831 bp, Homo sapiens
  Payload ID: 20418
  Gene Name: zymogen granule protein 16B
  Uniprot ID: Q96DA0
  ENST ID: ENST00000382280
  CDS Start-End: 80-706
ccctgggccttcccccaggaagagccccacggccagctccttcctgttcccctggcggcccctcgcttcttccttctggatgggggcccagggggcccaggagagtataaaggcgatgtggagggtgcccggcacaaccagacgcccagtcacaggcgagagccctgggatgcaccggccagaggccatgctgctgctgctcacgcttgccctcctggggggccccacctgggcagggaagatgtatggccctggaggaggcaagtatttcagcaccactgaagactacgaccatgaaatcacagggctgcgggtgtctgtaggtcttctcctggtgaaaagtgtccaggtgaaacttggagactcctgggacgtgaaactgggagccttaggtgggaatacccaggaagtcaccctgcagccaggcgaatacatcacaaaagtctttgtcgccttccaagctttcctccggggtatggtcatgtacaccagcaaggaccgctatttctattttgggaagcttgatggccagatctcctctgcctaccccagccaagaggggcaggtgctggtgggcatctatggccagtatcaactccttggcatcaagagcattggctttgaatggaattatccactagaggagccgaccactgagccaccagttaatctcacatactcagcaaactcacccgtgggtcgctagggtggggtatggggccatccgagctgaggccatctgggtggtggtggctgatggtactggagtaactgagtcgggacgctgaatctgaatccaccaataaataaaggttctgcagaatcagtgca

SEQ ID NO: 204887 - DNA, 582 bp, Homo sapiens
  Payload ID: 20418
  Gene Name: zymogen granule protein 16B
  ENST ID: ENST00000571723
  CDS Start-End: 1-209
ccagacgcccagtcacaggcgagagccctgggatgcaccggccagaggccatgctgctgctgctcacgcttgccctcctggggggccccacctgggcagggaagatgtatggccctggaggaggcaagtatttcagcaccactgaagactacgaccatgaaatcacagggctgcgggtgtctgtaggtcttctcctggtgaaaaggtgagtagggctatggtcatgggcccagcgccatgtcccctcccatcccacagtttcaggaactcagggcagggggtaagcacccgtggccacttttgccacacatgcctggctactgtcgatgcttcctggctcccgctgatgcttcctggctggagcggagacggtcagaccgtcctccctaccttctcccttcaacccaagctcaactcaaccaaaaatggcccctctgtccccatgcctgataggaaagtcaggggaaagtctgtccgattactgtcaaagaagacaggaggtaagggtcagagtggaccactgactgaatatgagtcgcagaagtgttagaggcagaagtccagggccatttccttaatatc

SEQ ID NO: 204888 - DNA, 1468 bp, Homo sapiens
  Payload ID: 20418
  Gene Name: zymogen granule protein 16B
  ENST ID: ENST00000570670
  CDS Start-End: 1-286
ggcccagggggcccaggagagtataaaggcgatgtggagggtgcccggcacaaccagacgcccagtcacaggcgagagccctgggatgcaccggccagaggccatgctgctgctgctcacgcttgccctcctggggggccccacctgggcagggaagatgtatggccctggaggaggcaagtatttcagcaccactgaagactacgaccatgaaatcacagggctgcgggtgtctgtaggtcttctcctggtgaaaagatttctggaaggagttatttatgagtgaagagctggagaatccattcgcaaactgatgcatgaaagtgattagcaagagaaagttgtgagacaaaacagagaagctgagaggccagaaacctctacccaggacgctgagctcctggcggatccgatgagtccctccaggacaccgtccaccctgggatgaaggcagaggagttggaaggaggcgaggccgtcacgggacaacaggaccctatgaaggtgggcccacagcaaaaggagagatgattctagagcatccagtcttctagggcagcaaaacaacctaaattttctaagaggccacccagctgagggtgcccccggggagggctgaggcgtcagggtgacggctccactgcccactcacctgcgacctcaaagcccctctcctccttggggtgctcctgacagccacctccagggcaggcgagtggcgctgggacaaaggctggcccgactgcgccccacccaagcagacggtccttcccccagacctggcgccaaactggagtgaaagcccgaccaccgtgtctcacagggaaactgacaccagatgcgaacttccaaatggatccctccctgcaagtgtggagctggcgctaccaggcactgctctggccatgcgtctaagacacaggcagagggcgctgcccaccacgctggcgacggcctcaaagcccctgttcatgcctgggacagcgcccaaggaccttgctcatgcctgggacaggccccagggcccccactggctgcagtcagcagcgggcagggtggtgggggaaggtatggacactccgtgggccggagctgggagaacaaggcctattattggacacctggtggccatggcaaccacacaaggatgcctgagactgaaaatctgtgggcttcaaggagctccagctcttgcactggctgagtcacagtgactatataactcttactcccacttttgggacactttttgagagggacagggatcctatctaactacacgggacagacatcgcccaagaccgtcctgagcaagcctggacgctgtgaccctaacgatgaaggtgtcccgcagacaatgtccggggcaggcaccatgctctcccaacctaccacagccagatgtttttgtaaagaacaataaaaatgaattactagaaaagcaaagacataaaatacacataaaaaa

SEQ ID NO: 204889 - DNA, 716 bp, Homo sapiens
  Payload ID: 20418
  Gene Name: zymogen granule protein 16B
  ENST ID: ENST00000572863
  CDS Start-End: 57-593
acactggcccttgctttggagtcaggaggcctctcttcttcccacagagccctgggatgcaccggccagaggccatgctgctgctgctcacgcttgccctcctggggggccccacctgggcagggaagatgtatggccctggaggaggcaagtatttcagcaccactgaagactacgaccatgaaatcacagggctgcgggtgtctgtaggtcttctcctggtgaaaagtgtccaggtgaaacttggagactcctgggacgtgaaactgggagccttaggtgggaatacccaggaagtcaccctgcagccaggcgaatacatcacaaaagtctttgtcgccttccaagctttcctccggggtatggtcatgtacaccagcaaggaccgctatttctattttgggaagcttgatggccagatctcctctgcctaccccagccaagaggggcaggtgctggtgggcatctatggccagtatcaactccttggcatcaagagcattggctttgaatggaattatccactagaggagccgaccactgagccaccagttaatctcacatactcagcaaactcacccgtgggtcgctagggtggggtatggggccatccgagctgaggccatctgggtggtggtggctgatggtactggagtaactgagtcgggacgctgaatctgaatccaccaataaataaaggttctgcagaatcagtg

SEQ ID NO: 204890 - DNA, 1468 bp, Homo sapiens; identical to SEQ ID NO: 204888
  Payload ID: 20418
  Gene Name: Zymogen granule protein 16B
  ENST ID: ENST00000635502
  CDS Start-End: 1-286

SEQ ID NO: 204891 - DNA, 831 bp, Homo sapiens; identical to SEQ ID NO: 204886
  Payload ID: 20418
  Gene Name: Zymogen granule protein 16B
  ENST ID: ENST00000634500
  CDS Start-End: 80-706

SEQ ID NO: 204892 - DNA, 716 bp, Homo sapiens; identical to SEQ ID NO: 204889
  Payload ID: 20418
  Gene Name: Zymogen granule protein 16B
  ENST ID: ENST00000634906
  CDS Start-End: 57-593

SEQ ID NO: 204893 - DNA, 582 bp, Homo sapiens; identical to SEQ ID NO: 204887
  Payload ID: 20418
  Gene Name: Zymogen granule protein 16B
  ENST ID: ENST00000634234
  CDS Start-End: 1-209

SEQ ID NO: 204894 - DNA, 2493 bp, Homo sapiens
  Payload ID: 20419
  Gene Name: zyxin
  Uniprot ID: Q15942
  ENST ID: ENST00000322764
  CDS Start-End: 346-2064
ctgagccgggctggggcggcgggggcggcagtgagtggggtgggggcgagcggacctcggcggagcctccggcctgaggcaggatcagggccccttcctgggggagtttcctgcctggtccgcccttccccgctctccccgccccctctccgggccgctccttgtatggtctgggcgccgctctctccccgccccctctcttctccctccctcctccttccgtgtgtccctccccgcccggctggaggctgctccggaccgggacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccagaa

SEQ ID NO: 204895 - DNA, 2050 bp, Homo sapiens
  Payload ID: 20419
  Gene Name: zyxin
  ENST ID: ENST00000354434
  CDS Start-End: 1-1623
gcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacaggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 204896 - DNA, 2123 bp, Homo sapiens
  Payload ID: 20419
  Gene Name: zyxin
  Uniprot ID: Q15942
  ENST ID: ENST00000392910
  CDS Start-End: 449-1696
agatgttcttacctcatcgtggagctcgtggctgggagccagggctcctgggaccgttccaagtcccccgcctgggagtgggagtcgggaatgtggggcacgaatcttcccctccgggtccgttttccgaagtgtaacgggagctgcaccactcctcggcagtgcgcccggcctttcctgacctgactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 204897 - DNA, 703 bp, Homo sapiens
  Payload ID: 20419
  Gene Name: zyxin
  ENST ID: ENST00000457235
  CDS Start-End: 212-703
cggcgccgaggcggccacccgagacgcggcgcgcacgctccggcctgcggtgaggcgcggggagcggcagggcggccccacggggagggggcgcggggcgccgggagggggcgagtgggggtcaccaaggggagctgggaccgcctggggctcctgagcccggctccgcgctgcgtaacccggcgacccaccccagcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttc

SEQ ID NO: 204898 - DNA, 926 bp, Homo sapiens
  Payload ID: 20419
  Gene Name: zyxin
  ENST ID: ENST00000446634
  CDS Start-End: 413-926
tccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccagttcaggaaataagatcgtccaatttctggtgacgaagatgaccctgatggtcatctagtccaagcatccagagtccactgatagtgttgatgtctacctacactcggacacagcataggaagaaatgccaagggccagtgagctttgcagaatcctgggctgctcagcagcaggcaggccgggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctcct

SEQ ID NO: 204899 - DNA, 632 bp, Homo sapiens
  Payload ID: 20419
  Gene Name: zyxin
  ENST ID: ENST00000436448
  CDS Start-End: 1-530
agtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggggctgctcagcagcaggcaggccgggtgcgctcccctggggccccagggcccctgactctgaaggaggtggaggagctggagcagctgacccagcagctaatgcaggacatggagcatcctcagaggcagaatgtggctgtcaacgaactctgcggcc

SEQ ID NO: 204900 - DNA, 533 bp, Homo sapiens
  Payload ID: 20419
  Gene Name: zyxin
  ENST ID: ENST00000449630
  CDS Start-End: 1-533
ccttccgtgtgtccctccccgcccggctggaggctgctccggaccgggacgcagagtctgcggacccggcgccgaggcggccacccgagacgcggcgcgcacgctccggcctgcgactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctct

SEQ ID NO: 204901 - protein, 44 aa, Artificial Sequence
  Description of Artificial Sequence: Synthetic polypeptide
YADAIFTNSYRKVLGQLSARKLLQDIMSRQQGESNQERGARARL

SEQ ID NO: 204902 - protein, 141 aa, Artificial Sequence
  Description of Artificial Sequence: Synthetic polypeptide
MSYDYMEGGDIRVRRLFCRTQWYLRIDKRGKVKGTQEMKNNYNIMEIRTVAVGIVAIKGVESEFYLAMNKEGKLYAKKECNEDCNFKELILENHYNTYASAKWTHNGGEMFVALNQKGIPVRGKKTKKEQKTAHFLPMAIT

SEQ ID NO: 204903 - protein, 34 aa, Artificial Sequence
  Description of Artificial Sequence: Synthetic polypeptide
  MOD_RES (29)..(29): Any amino acid
AVSEHQLLHDKGKSIQDLRRRELLEKLLXKLHTA

SEQ ID NO: 204904 - protein, 383 aa, Artificial Sequence
  Description of Artificial Sequence: Synthetic polypeptide
MGVLLTQRTLLSLVLALLFPSMASMAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204905 - protein, 450 aa, Artificial Sequence
  Description of Artificial Sequence: Synthetic polypeptide
EVQLQQSGAELVKPGASVKLSCTASGFNIKDTYVHWVKQRPEQGLEWIGRIDPANGYTKYDPKFQGKATITADTSSNTAYLQLSSLTSEDTAVYYCVRPLYDYYAMDYWGQGTSVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204906 - protein, 214 aa, Artificial Sequence
  Description of Artificial Sequence: Synthetic polypeptide
DILMTQSPSSMSVSLGDTVSITCHASQGISSNIGWLQQKPGKSFMGLIYYGTNLVDGVPSRFSGSGSGADYSLTISSLDSEDFADYYCVQYAQLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 204907 - protein, 444 aa, Artificial Sequence
  Description of Artificial Sequence: Synthetic polypeptide
QVQLVQSGAEVKKPGASVKVSCKVSGYTLSDLSIHWVRQAPGKGLEWMGGFDPQDGETIYAQKFQGRVTMTEDTSTDTAYMELSSLKSEDTAVYYCATGSSSSWFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 204908 - protein, 214 aa, Artificial Sequence
  Description of Artificial Sequence: Synthetic polypeptide
DIQMTQSPSSVSASVGDRVTITCRASQGISSWLAWYQQKPGKAPKLLIYGASNLESGVPSRFSGSGSGTDFTLTISSLQPEDFANYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204909 - protein, 453 aa, Artificial Sequence
  Description of Artificial Sequence: Synthetic polypeptide
QVQLVESGGGVVQPGRSLRLSCAASGFAFSSYGMHWVRQAPGKGLEWVAVIWFDGTKKYYTDSVKGRFTISRDNSKNTLYLQMNTLRAEDTAVYYCARDRGIGARRGPYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 204910 - protein, 214 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204911 - protein, 431 aa, Artificial Sequence
  Description of Artificial Sequence: Synthetic polypeptide
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 204912 - protein, 228 aa, Artificial Sequence
  Description of Artificial Sequence: Synthetic polypeptide
EVQLVESGGGLVQPGGSLRLSCAASGFTFSSYGMSWVRQAPGKGLEWVATITSGGSYTYYVDSVKGRFTISRDNAKNTLYLQMNSLRAEDTAVYYCVRIGEDALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCAA

SEQ ID NO: 204913 - protein, 214 aa, Artificial Sequence
  Description of Artificial Sequence: Synthetic polypeptide
DIQMTQSPSSLSASVGDRVTITCRASQDIAGSLNWLQQKPGKAIKRLIYATSSLDSGVPKRFSGSRSGSDYTLTISSLQPEDFATYYCLQYGSFPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204914 - protein, 457 aa, Artificial Sequence [sequence omitted]

SEQ ID NO: 204915 - protein, 250 aa, Artificial Sequence; identical to SEQ ID NO: 13209
  Description of Artificial Sequence: Synthetic polypeptide

SEQ ID NO: 204916 - protein, 451 aa, Artificial Sequence
  Description of Artificial Sequence: Synthetic polypeptide
QVQLQESGPGLVRPSQTLSLTCTVSGFTFTDFYMNWVRQPPGRGLEWIGFIRDKAKGYTTEYNPSVKGRVTMLVDTSKNQFSLRLSSVTAADTAVYYCAREGHTAAPFDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204917 - protein, 211 aa, Artificial Sequence
  Description of Artificial Sequence: Synthetic polypeptide
DIQMTQSPSSLSASVGDRVTITCKASQNIDKYLNWYQQKPGKAPKLLIYNTNNLQTGVPSRFSGSGSGTDFTFTISSLQPEDIATYYCLQHISRPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNR

SEQ ID NO: 204918 - protein, 447 aa, Artificial Sequence
  Description of Artificial Sequence: Synthetic polypeptide
EVQLVESGGGLVQPGGSLRLSCAASGFTFNNYAMNWVRQAPGKGLDWVSTISGSGGTTNYADSVKGRFIISRDSSKHTLYLQMNSLRAEDTAVYYCAKDSNWGNFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 204919 - protein, 220 aa, Artificial Sequence
  Description of Artificial Sequence: Synthetic polypeptide
DIVMTQSPDSLAVSLGERATINCKSSQSVLYRSNNRNFLGWYQQKPGQPPNLLIYWASTRESGVPDRFSGSGSGTDFTLTISSLQAEDVAVYYCQQYYTTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204920 - protein, 511 aa, Artificial Sequence; identical to SEQ ID NO: 4489
  Description of Artificial Sequence: Synthetic polypeptide

SEQ ID NO: 204921 - protein, 653 aa, Artificial Sequence
  Description of Artificial Sequence: Synthetic polypeptide
MRPLRPRAALLALLASLLAAPPVAPAEAPHLVQVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 204922 - protein, 449 aa, Artificial Sequence
  Description of Artificial Sequence: Synthetic polypeptide
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGSGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204923 - protein, 213 aa, Artificial Sequence
  Description of Artificial Sequence: Synthetic polypeptide
DIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204924 - protein, 359 aa, Artificial Sequence
  Description of Artificial Sequence: Synthetic polypeptide
ANSFLFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDAGGPHVTRFKDTYFVTGIVSWGEGCARKGKYGIYTKVTAFLKWIDRSMKTRGLPKAKSHAPEVITSSPLK

SEQ ID NO: 204925 - protein, 448 aa, Artificial Sequence
  Description of Artificial Sequence: Synthetic polypeptide
EVQLVESGGGLVQPGGSLRLSCAASGFTFISYAMSWVRQAPGKGLEWVASISSGGNTYYPDSVKGRFTISRDNAKNSLYLQMNSLRAEDTAVYYCARLDGYYFGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEALGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204926 - protein, 218 aa, Artificial Sequence
  Description of Artificial Sequence: Synthetic polypeptide
DIQMTQSPSSLSASVGDRVTITCKASESVDNYGKSLMHWYQQKPGKAPKLLIYRASNLESGVPSRFSGSGSGTDFTLTISSLQPEDFATYYCQQSNEDPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204927 - protein, 464 aa, Artificial Sequence; identical to SEQ ID NO: 78120
  Description of Artificial Sequence: Synthetic polypeptide

SEQ ID NO: 204928 - protein, 726 aa, Artificial Sequence
  Description of Artificial Sequence: Synthetic polypeptide
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSLKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKDIDDDDDDDDDD

SEQ ID NO: 204929 - protein, 133 aa, Artificial Sequence
  Description of Artificial Sequence: Synthetic polypeptide
AMRSCPEEQYDHLLRDCISCEGAPSVFLFPHNAKTKPREETISKAKGQPRGQPENNYKTTHYTQKSLSLSWDPLLGTCMSASICGQHPKQPKPKDTLMISQYNSTYRVVSEPQVYTLPPSPPVLDSDGSFPGK

SEQ ID NO: 204930 - protein, 441 aa, Artificial Sequence
  Description of Artificial Sequence: Synthetic polypeptide
EVQLVESGGGLVQPGGSLRLSCAASGFTFSNYWMSWVRQAPGKGLEWVATIKQDGSQKNYVDSVKGRFTISRDNAKNSLYLRLNSLRAEDTAVYYCATELFDLWGRGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 204931 - protein, 214 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204932 - protein, 421 aa, Artificial Sequence
  Description of Artificial Sequence: Synthetic polypeptide
AVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 204933 - protein, 446 aa, Artificial Sequence
  Description of Artificial Sequence: Synthetic polypeptide
QLQQSGTVLARPGASVKMSCKASGYSFTRYWMHWIKQRPGQGLEWIGAIYPGNSDTSYNQKFEGKAKLTAVTSASTAYMELSSLTHEDSAVYYCSRDYGYYFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204934 - protein, 210 aa, Artificial Sequence
  Description of Artificial Sequence: Synthetic polypeptide
QIVSTQSPAIMSASPGEKVTMTCSASSSRSYMQWYQQKPGTSPKRWIYDTSKLASGVPARFSGSGSGTSYSLTISSMEAEDAATYYCHQRSSYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 204935 - protein, 450 aa, Artificial Sequence
  Description of Artificial Sequence: Synthetic polypeptide
EVQLQQSGPELEKPGASVKLSCKASGYSFTGYNMNWVKQSHGKSLEWIGHIDPYYGDTSYNQKFRGKATLTVDKSSSTAYMQLKSLTSEDSAVYYCVKGGYYGHWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204936 - protein, 214 aa, Artificial Sequence
  Description of Artificial Sequence: Synthetic polypeptide
DIQMTQSPSSLSASLGERVSLTCRASQDIGSSLNWLQQGPDGTIKRLIYATSSLDSGVPKRFSGSRSGSDYSLTISSLESEDFVDYYCLQYVSSPPTFGAGTKLELKRADAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204937 - protein, 357 aa, Artificial Sequence
  Description of Artificial Sequence: Synthetic polypeptide
MHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204938 - protein, 451 aa, Artificial Sequence
  Description of Artificial Sequence: Synthetic polypeptide
EVQLVQSGAEVKKPGASVKVSCKASGYTFTSYVIHWVRQRPGQGLAWMGYINPYNDGTKYNERFKGKVTITSDRSTSTVYMELSSLRSEDTAVYLCGREGIRYYGLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204939 - protein, 214 aa, Artificial Sequence
  Description of Artificial Sequence: Synthetic polypeptide
DIQMTQSPSSLSASVGDRVTITCGTSEDIINYLNWYQQKPGKAPKLLIYHTSRLQSGVPSRFSGSGSGTDFTLTISSLQPEDFATYYCQQGYTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204940 - protein, 453 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204941 - protein, 214 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204942 - protein, 449 aa, Artificial Sequence
  Description of Artificial Sequence: Synthetic polypeptide
EVQLVQSGAEVKKSGESLKISCKGSGYSFTSYWIGWVRQMPGKGLEWMGIFYPGDSSTRYSPSFQGQVTISADKSVNTAYLQWSSLKASDTAMYYCARRRNWGNAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204943 - protein, 215 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSTWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204944 - protein, 444 aa, Artificial Sequence
  Description of Artificial Sequence: Synthetic polypeptide
QVQLVQSGAEVKKPGASVKVSCKASGYTFTSSYINWVRQAPGQGLEWMGTINPVSGSTSYAQKFQGRVTMTRDTSISTAYMELSRLRSDDTAVYYCARGGWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 204945 - protein, 217 aa, Artificial Sequence
  Description of Artificial Sequence: Synthetic polypeptide
QSALTQPASVSGSPGQSITISCTGTSSDVGSYNYVNWYQQHPGKAPKLMIYGVSKRPSGVSNRFSGSKSGNTASLTISGLQAEDEADYYCGTFAGGSYYGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 204946 - protein, 504 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 204947 - protein, 290 aa, Artificial Sequence
  Description of Artificial Sequence: Synthetic polypeptide
GCKWDLLIKQWVCDPLGSGSATGGSGSTASSGSGSATHMLPGCKWDLLIKQWVCDPLGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204948 - protein, 448 aa, Artificial Sequence
  Description of Artificial Sequence: Synthetic polypeptide
QVQLQQSRAELVRPGASVTLSCKPSGYTFTDYEVHWVKQTPVHGLEWIGAIDPETGGTADNQKFKGKAILTADKSSSTAYMELRSLTSEDSAVYYCTNFVDVWGTGTTVTVSSASTTAPSVFPLAPSCGSQSGSTVALACLVSGYFPEPVTVSWNSGSLTSGVHTFPSVLQSSGLYSLSSMVTVPSSRWPSETFTCNVAHPASKTKVDKPVPKRENGRVPRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQKSLSHSPGK

SEQ ID NO: 204949 - protein, 219 aa, Artificial Sequence
  Description of Artificial Sequence: Synthetic polypeptide
DVVMSQSPSSLAVSVGEKVTMSCKSSQSLLYSGNQKNYLAWYQQKPGQSPRLLIYWASTRESGVPDRFTGSGSGTDFTLTISSVKAEDLAVFYCQQYYNYPLTFGGGTHLTVLGQPKASPSVTLFPPSSEELGANKATLVCLISDFYPSGVTVAWKADGSPITQGVETTKPSKQSNNKYAASSYLSLTPDKWKSHSSFSCLVTHEGSTVEKKVAPAECS

SEQ ID NO: 204950 - protein, 444 aa, Artificial Sequence
  Description of Artificial Sequence: Synthetic polypeptide
QVQLVQSGAEVKKPGASVKVSCKVSGFPIKDTFQHWVRQAPGKGLEWMGWSDPEIGDTEYASKFQGRVTMTEDTSTDTAYMELSSLRSEDTAVYYCATGDTTYKFDFWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 204951 - protein, 214 aa, Artificial Sequence
  Description of Artificial Sequence: Synthetic polypeptide
DIQMTQSPSSLSASVGDRVTITCKASQDVHTAVAWYQQKPGKAPKLLIYWASTRWTGVPSRFSGSGSGTDFTLTISSLQPEDFATYYCQQYSDYPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204952 - protein, 444 aa, Artificial Sequence
  Description of Artificial Sequence: Synthetic polypeptide
QVQLVQSGAEVKKPGASVKVSCKASGYTFTSYYMHWVRQAPGQGLEWMGEISPFGGRTNYNEKFKSRVTMTRDTSTSTVYMELSSLRSEDTAVYYCARERPLYASDLWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 204953 - protein, 214 aa, Artificial Sequence
  Description of Artificial Sequence: Synthetic polypeptide
DIQMTQSPSSLSASVGDRVTITCRASQGISSALAWYQQKPGKAPKLLIYSASYRYTGVPSRFSGSGSGTDFTFTISSLQPEDIATYYCQQRYSLWRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204954 - protein, 446 aa, Artificial Sequence
  Description of Artificial Sequence: Synthetic polypeptide
QIQLQQSGPEVVKPGASVKISCKASGYTFTDYYITWVKQKPGQGLEWIGWIYPGSGNTKYNEKFKGKATLTVDTSSSTAFMQLSSLTSEDTAVYFCANYGNYWFAYWGQGTQVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 204955 - protein, 218 aa, Artificial Sequence
  Description of Artificial Sequence: Synthetic polypeptide
DIVLTQSPASLAVSLGQRATISCKASQSVDFDGDSYMNWYQQKPGQPPKVLIYAASNLESGIPARFSGSGSGTDFTLNIHPVEEEDAATYYCQQSNEDPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204956 - protein, 445 aa, Artificial Sequence
  Description of Artificial Sequence: Synthetic polypeptide
QVQLVESGGGVVQPGRSLRLSCAASGFTFSSYGMHWVRQAPGKGLEWVAFIRYDGSNKYYADSVKGRFTISRDNSKNTLYLQMNSLRAEDTAVYYCKTHGSHDNWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204957 - protein, 217 aa, Artificial Sequence
  Description of Artificial Sequence: Synthetic polypeptide
QSVLTQPPSVSGAPGQRVTISCSGSRSNIGSNTVKWYQQLPGTAPKLLIYYNDQRPSGVPDRFSGSKSGTSASLAITGLQAEDEADYYCQSYDRYTHPALLFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 204958 - protein, 442 aa, Artificial Sequence
  Description of Artificial Sequence: Synthetic polypeptide
QVQLVQSGAEVKKPGASVKVSCKASGYTFTRYGISWVRQAPGQGLEWMGWISTYSGNTNYAQKLQGRVTMTTDTSTSTAYMELRSLRSDDTAVYYCARRQLYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 204959 - protein, 214 aa, Artificial Sequence
  Description of Artificial Sequence: Synthetic polypeptide
EIVMTQSPATLSVSPGERATLSCRASQSVSSNLAWFQQKPGQAPRPLIYDASTRATGVPARFSGSGSGTDFTLTISSLQSEDFAVYYCQQYDNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204960 - protein, 447 aa, Artificial Sequence
  Description of Artificial Sequence: Synthetic polypeptide
QVQLVQSGAEVKKPGASVKISCKVSGYTLRGYWIEWVRQAPGKGLEWIGQILPGTGRTNYNEKFKGRVTMTADTSTDTAYMELSSLRSEDTAVYYCARFDGNYGYYAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 204961 - protein, 215 aa, Artificial Sequence
  Description of Artificial Sequence: Synthetic polypeptide
QAVVTQEPSLTVSPGGTVTLTCRSSTGAVTTSNYANWFQQKPGQAPRTLIGGTNNRAPGVPARFSGSLLGGKAALTLSGAQPEDEAEYYCALWYSNHWVFGGGTKLTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 204962 - protein, 141 aa, Artificial Sequence; identical to SEQ ID NO: 10513
  Description of Artificial Sequence: Synthetic polypeptide

SEQ ID NO: 204963 - protein, 448 aa, Artificial Sequence
  Description of Artificial Sequence: Synthetic polypeptide
QVQLVESGGGVVQPGRSLRLSCAASGFTFSVYGMNWVRQAPGKGLEWVAIIWYDGDNQYYADSVKGRFTISRDNSKNTLYLQMNGLRAEDTAVYYCARDLRTGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204964 - protein, 214 aa, Artificial Sequence
  Description of Artificial Sequence: Synthetic polypeptide
EIVLTQSPDFQSVTPKEKVTITCRASQSIGSSLHWYQQKPDQSPKLLIKYASQSFSGVPSRFSGSGSGTDFTLTINSLEAEDAAAYYCHQSSSLPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204965 - protein, 449 aa, Artificial Sequence
  Description of Artificial Sequence: Synthetic polypeptide
QVQLVQSGAEVKKPGETVKISCKASDYTFTYYGMNWVKQAPGQGLKWMGWIDTTTGEPTYAQKFQGRIAFSLETSASTAYLQIKSLKSEDTATYFCARRGPYNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204966 - protein, 449 aa, Artificial Sequence; identical to SEQ ID NO: 204965
  Description of Artificial Sequence: Synthetic polypeptide

SEQ ID NO: 204967 - protein, 219 aa, Artificial Sequence
  Description of Artificial Sequence: Synthetic polypeptide
DIVMTQSPLSVPVTPGEPVSISCRSSKSLLHSNGNTYLYWFLQRPGQSPQLLIYRMSNLVSGVPDRFSGSGSGTAFTLRISRVEAEDVGVYYCLQHLEYPFTFGPGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204968 - protein, 219 aa, Artificial Sequence; identical to SEQ ID NO: 204967
  Description of Artificial Sequence: Synthetic polypeptide

SEQ ID NO: 204969 - protein, 259 aa, Artificial Sequence
  Description of Artificial Sequence: Synthetic polypeptide
EVQLVESGGGLVQPGGSLRLSCAASGRTFSYNPMGWFRQAPGKGRELVAAISRTGGSTYYPDSVEGRFTISRDNAKRMVYLQMNSLRAEDTAVYYCAAAGVRAEDGRVRTLPSEYTFWGQGTQVTVSSAAAEVQLVESGGGLVQPGGSLRLSCAASGRTFSYNPMGWFRQAPGKGRELVAAISRTGGSTYYPDSVEGRFTISRDNAKRMVYLQMNSLRAEDTAVYYCAAAGVRAEDGRVRTLPSEYTFWGQGTQVTVSS

SEQ ID NO: 204970 - protein, 449 aa, Artificial Sequence
  Description of Artificial Sequence: Synthetic polypeptide
QVQLVQSGAEVKKPGSSVKVSCKASGGTFSSYGISWVRQAPGQGLEWMGGIIPIFGTANYAQKFQGRVTITADESTSTAYMELSSLRSEDTAVYYCARYDGIYGELDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204971 - protein, 216 aa, Artificial Sequence
  Description of Artificial Sequence: Synthetic polypeptide
EIVLTQSPATLSLSPGERATLSCRASQSVSDAYLAWYQQKPGQAPRLLIYDASSRATGVPARFSGSGSGTDFTLTISSLEPEDFAVYYCHQYIQLHSFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204972 - protein, 544 aa, Artificial Sequence
  Description of Artificial Sequence: Synthetic polypeptide
SYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHRFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 204973 - protein, 452 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204974 - protein, 213 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGA

SEQ ID NO: 204975 - protein, 145 aa, Artificial Sequence
  Description of Artificial Sequence: Synthetic polypeptide
SKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 204976 - protein, 145 aa, Artificial Sequence; identical to SEQ ID NO: 204975
  Description of Artificial Sequence: Synthetic polypeptide

SEQ ID NO: 204977 - protein, 372 aa, Artificial Sequence
  Description of Artificial Sequence: Synthetic polypeptide
GNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPQLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 204978 - protein, 225 aa, Artificial Sequence
  Description of Artificial Sequence: Synthetic polypeptide
HHHHHHEVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 204979 - protein, 481 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTRHRQPRGWEQLYNTVSFNLGEAYEYPTFIQDLRNELAKGTPVCQLPVTLQTIADDKRFVLVDITTTSKKTVKVAIDVTDVYVVGYQDKWDGKDRAVFLDKVPTVATSKLFPGVTNRVTLTFDGSYQKLVNAAKADRKALELGVNKLEFSIEAIHGKTINGQEAAKFFLIVIQMVSEAARFKYIETEVVDRGLYGSFKPNFKVLNLENNWGDISDAIHKSSPQCTTINPALQLISPSNDPWVVNKVSQISPDMGILKFKSSK

SEQ ID NO: 204980 - protein, 460 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARAPLRFLEWSTQDHYYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204981 - protein, 214 aa, Artificial Sequence
  Description of Artificial Sequence: Synthetic polypeptide
SSELTQDPAVSVALGQTVRITCQGDSLRSYYATWYQQKPGQAPILVIYGENKRPSGIPDRFSGSSSGNTASLTITGAQAEDEADYYCKSRDGSGQHLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPAECS

SEQ ID NO: 204982 - protein, 450 aa, Artificial Sequence
  Description of Artificial Sequence: Synthetic polypeptide
EVQLVESGGGLVQPGGSLRLSCAASGFSLSNYYVTWVRQAPGKGLEWVGIIYGSDETAYATSAIGRFTISRDNSKNTLYLQMNSLRAEDTAVYYCARDDSSDWDAKFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204983 - protein, 217 aa, Artificial Sequence
  Description of Artificial Sequence: Synthetic polypeptide
AIQMTQSPSSLSASVGDRVTITCQASQSINNELSWYQQKPGKAPKLLIYRASTLASGVPSRFSGSGSGTDFTLTISSLQPDDFATYYCQQGYSLRNIDNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204984 - protein, 449 aa, Artificial Sequence
  Description of Artificial Sequence: Synthetic polypeptide
QVQLQQSGAEVKKPGASVKVSCEASGYTFPSYVLHWVKQAPGQGLEWIGYINPYNDGTQYNEKFKGKATLTRDTSINTAYMELSRLRSDDTAVYYCARGFGGSYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204985 - protein, 215 aa, Artificial Sequence
  Description of Artificial Sequence: Synthetic polypeptide
DIQLTQSPSSLSASVGDRVTMTCSASSSVSSSYLYWYQQKPGKAPKLWIYSTSNLASGVPARFSGSGSGTDFTLTISSLQPEDSASYFCHQWNRYPYTFGGGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204986 - protein, 452 aa, Artificial Sequence
  Description of Artificial Sequence: Synthetic polypeptide
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204987 - protein, 215 aa, Artificial Sequence
  Description of Artificial Sequence: Synthetic polypeptide
EIVLTQSPGTLSLSPGERATLSCRASQGISRSYLAWYQQKPGQAPSLLIYGASSRATGIPDRFSGSGSGTDFTLTISRLEPEDFAVYYCQQFGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204988 - protein, 526 aa, Artificial Sequence
  Description of Artificial Sequence: Synthetic polypeptide
GRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPGPGDKTHTCPLCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKATPPVLDSDGSFFLYSKLTVDKSRWQQGNVFSCSVMHEALHNHYTQKSLSLSPGK

SEQ ID NO: 204989 - protein, 196 aa, Artificial Sequence; identical to SEQ ID NO: 20041
  Description of Artificial Sequence: Synthetic polypeptide

SEQ ID NO: 204990 - protein, 267 aa, Artificial Sequence; identical to SEQ ID NO: 67363
  Description of Artificial Sequence: Synthetic polypeptide

SEQ ID NO: 204991 - protein, 267 aa, Artificial Sequence; identical to SEQ ID NO: 67363
  Description of Artificial Sequence: Synthetic polypeptide

SEQ ID NO: 204992 - protein, 267 aa, Artificial Sequence; identical to SEQ ID NO: 67363
  Description of Artificial Sequence: Synthetic polypeptide

SEQ ID NO: 204993 - protein, 438 aa, Artificial Sequence
  Description of Artificial Sequence: Synthetic polypeptide
EVQLVESGGGLVQPGGSLRLSCAASGFTFSSYGMSWVRQAPGKGLELVASINSNGGSTYYPDSVKGRFTISRDNAKNSLYLQMNSLRAEDTAVYYCASGDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 204994 - protein, 219 aa, Artificial Sequence
  Description of Artificial Sequence: Synthetic polypeptide
DIVMTQSPLSLPVTPGEPASISCRSSQSLVYSNGDTYLHWYLQKPGQSPQLLIYKVSNRFSGVPDRFSGSGSGTDFTLKISRVEAEDVGVYYCSQSTHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204995 - protein, 444 aa, Artificial Sequence
  Description of Artificial Sequence: Synthetic polypeptide
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204996 - protein, 219 aa, Artificial Sequence
  Description of Artificial Sequence: Synthetic polypeptide
DIQMTQSPSSLSASVGDRVTITCRSSQSLVHSNGNTFLHWYQQKPGKAPKLLIYTVSNRFSGVPSRFSGSGSGTDFTLTISSLQPEDFATYFCSQTTHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204997 - protein, 442 aa, Artificial Sequence
  Description of Artificial Sequence: Synthetic polypeptide
QVQLVQSGAEVKKPGSSVKVSCKASGYTFTSYRMHWVRQAPGQGLEWIGYINPSTGYTEYNQKFKDKATITADESTNTAYMELSSLRSEDTAVYYCARGGGVFDYWGQGTTLTVSSGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204998 - protein, 210 aa, Artificial Sequence
  Description of Artificial Sequence: Synthetic polypeptide
DIQMTQSPSTLSASVGDRVTITCSASSSISYMHWYQQKPGKAPKLLIYTTSNLASGVPARFSGSGSGTEFTLTISSLQPDDFATYYCHQRSTYPLTFGSGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNR

SEQ ID NO: 204999 - protein, 447 aa, Artificial Sequence
  Description of Artificial Sequence: Synthetic polypeptide
QVQLQQSGPGLVKPSQTLSLTCTVSGWSISGGWLWNWIRQPPGKGLQWIGWISWDGTNNWKPSLKDRVTISVDTSKNQFSLKLSSVTAADTAVWWCARWGRVFFDWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205000 - protein, 219 aa, Artificial Sequence
  Description of Artificial Sequence: Synthetic polypeptide
DIVMTQSPLSLPVTPGQPASISCRSSQSIVHSNGNTWLQWWLQKPGQSPQLLIWKVSNRLWGVPDRFSGSGSGTDFTLKISRVQAQDVGVWWCFQGSHVPWTFGQGTKVQIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205001 - protein, 452 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205002 - protein, 214 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205003 - protein, 328 aa, Artificial Sequence
  Description of Artificial Sequence: Synthetic polypeptide
DPVKPSRGPLVTCTCESPHCKGPTCRGAWCTVVLVREEGRHPQEHRGCGNLHRELCRGRPTEFVNHYCCDSHLCNHNVSLVLEATQPPSEQPGTDGQLATGGGTHTCPPCPAPEALGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPVPIEKTISKAKGQPREPQVYTLPPSREEMTKNQVSLTCLVKGFYPSDIAVEWESNGQPENNYKTTPPVLDSDGPFFLYSKLTVDKSRWQQGNVFSCSVMHEALHNHYTQKSLSLSPGK

SEQ ID NO: 205004 - protein, 444 aa, Artificial Sequence
  Description of Artificial Sequence: Synthetic polypeptide
QVQLVQSGAEVKKPGASVKISCKASGYSFTAYYIHWVKQAPGQGLEWIGYISSYNGATNYNQKFKGRVTFTTDTSTSTAYMELRSLRSDDTAVYYCARDYDYDVGMDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 205005 - protein, 218 aa, Artificial Sequence
  Description of Artificial Sequence: Synthetic polypeptide
DIVMTQSPDSLAVSLGERATISCRASESVDNYGISFMKWFQQKPGQPPKLLIYAASNQGSGVPDRFSGSGSGTDFTLTISSLQAEDVAVYYCQQSKEVPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205006 - protein, 450 aa, Artificial Sequence
  Description of Artificial Sequence: Synthetic polypeptide
QVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205007 - protein, 213 aa, Artificial Sequence
  Description of Artificial Sequence: Synthetic polypeptide
EIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205008 - protein, 282 aa, Artificial Sequence [sequence omitted]

SEQ ID NO: 205009 - protein, 443 aa, Artificial Sequence
  Description of Artificial Sequence: Synthetic polypeptide
EVQLLQSGPELEKPGASVMISCKASGSSFTGYNMNWVRQNIGKSLEWIGAIDPYYGGTSYNQKFKGRATLTVDKSSSTAYMHLKSLTSEDSAVYYCVSGMEYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205010 - protein, 220 aa, Artificial Sequence
  Description of Artificial Sequence: Synthetic polypeptide
EIVMTQSPATLSVSPGERATLSCRSSQSLVHRNGNTYLHWYLQKPGQSPKLLIHKVSNRFSGVPDRFSGSGSGTDFTLKISRVEAEDLGVYFCSQSTHVPPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205011 - protein, 450 aa, Artificial Sequence
  Description of Artificial Sequence: Synthetic polypeptide
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205012 - protein, 217 aa, Artificial Sequence
  Description of Artificial Sequence: Synthetic polypeptide
QSVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 205013 - protein, 445 aa, Artificial Sequence
  Description of Artificial Sequence: Synthetic polypeptide
EVQLLESGGGLVQPGGSLRLSCAASGFTFSSYAMSWVRQAPGKGLEWVSTISSGGSYTSYPDSVKGRFTISRDNSKNTLYLQMNSLRAEDTAVYYCAKQDYAMNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205014 - protein, 214 aa, Artificial Sequence
  Description of Artificial Sequence: Synthetic polypeptide
DIQMTQSPSSLSASVGDRVTITCKASQDVSTAVAWYQQKPGKAPKLLIYSASYRYTGVPSRFSGSGSGTDFTLTISSLQPEDFATYYCQQHYSTPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205015 - protein, 451 aa, Artificial Sequence
  Description of Artificial Sequence: Synthetic polypeptide
EVQLVQSGGGVERPGGSLRLSCAASGFTFDDYAMSWVRQAPGKGLEWVSGINWQGGSTGYADSVKGRVTISRDNAKNSLYLQMNSLRAEDTAVYYCAKILGAGRGWYFDYWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205016 - protein, 213 aa, Artificial Sequence
  Description of Artificial Sequence: Synthetic polypeptide
SELTQDPAVSVALGQTVRITCSGDSLRSYYASWYQQKPGQAPVLVIYGANNRPSGIPDRFSGSSSGNTASLTITGAQAEDEADYYCNSADSSGNHVVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 205017 - protein, 451 aa, Artificial Sequence
  Description of Artificial Sequence: Synthetic polypeptide
EVQLVESGGGLVQPGGSLRLSCAASGFTLSGDWIHWVRQAPGKGLEWVGEISAAGGYTDYADSVKGRFTISADTSKNTAYLQMNSLRAEDTAVYYCARESRVSFEAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205018 - protein, 214 aa, Artificial Sequence
  Description of Artificial Sequence: Synthetic polypeptide
DIQMTQSPSSLSASVGDRVTITCRASQNIATDVAWYQQKPGKAPKLLIYSASFLYSGVPSRFSGSGSGTDFTLTISSLQPEDFATYYCQQSEPEPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205019 - protein, 451 aa, Artificial Sequence; identical to SEQ ID NO: 205017
  Description of Artificial Sequence: Synthetic polypeptide

SEQ ID NO: 205020 - protein, 214 aa, Artificial Sequence; identical to SEQ ID NO: 205018
  Description of Artificial Sequence: Synthetic polypeptide

SEQ ID NO: 205021 - protein, 451 aa, Artificial Sequence
  Description of Artificial Sequence: Synthetic polypeptide
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205022 - protein, 215 aa, Artificial Sequence
  Description of Artificial Sequence: Synthetic polypeptide
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205023 - protein, 60 aa, Artificial Sequence
  Description of Artificial Sequence: Synthetic polypeptide
EAMHSFCAFKADDGPCRAAHPRWFFNIFTRQCEEFIYGGCEGNQNRFESLEECKKMCTRD

SEQ ID NO: 205024 - protein, 256 aa, Artificial Sequence
  Description of Artificial Sequence: Synthetic polypeptide
MAEVQLVESGAEVKKPGESLRISCKGSGCIISSYWISWVRQMPGKGLEWMGKIDPGDSYINYSPSFQGHVTISADKSINTAYLQWNSLKASDTAMYYCARGGRDFGDSFDYWGQGTLVTVSSGGGGSGGGGSGGGGSDVVMTQSPSFLSAFVGDRITITCRASSGISRYLAWYQQAPGKAPKLLIYAASTLQTGVPSRFSGSGSGTEFTLTINSLQPEDFATYYCQHLNSYPLTFGGGTKVDIKRAAALEHHHHHH

SEQ ID NO: 205025 - protein, 449 aa, Artificial Sequence
  Description of Artificial Sequence: Synthetic polypeptide
EVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205026 - protein, 214 aa, Artificial Sequence
  Description of Artificial Sequence: Synthetic polypeptide
DIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205027 - protein, 446 aa, Artificial Sequence
  Description of Artificial Sequence: Synthetic polypeptide
QVQLVQSGAEVKKPGASVKVSCKASGYTFTSYDISWVRQAPGQGLEWMGVIWTDGGTNYAQKLQGRVTMTTDTSTSTAYMELRSLRSDDTAVYYCARDQRLYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205028 - protein, 213 aa, Artificial Sequence
  Description of Artificial Sequence: Synthetic polypeptide
DIQMTQSPSSLSASVGDRVTITCRASEDVNTYVSWYQQKPGKAPKLLIYAASNRYTGVPSRFSGSGSGTDFTLTISSLQPEDFATYYCQQSFSYPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205029 - protein, 441 aa, Artificial Sequence
  Description of Artificial Sequence: Synthetic polypeptide
QVQLVQSGAEVKKPGASVKVSCKASGYTFTDYYMHWVRQAPGQGLEWMGRVNPNRRGTTYNQKFEGRVTMTTDTSTSTAYMELRSLRSDDTAVYYCARANWLDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 205030 - protein, 215 aa, Artificial Sequence
  Description of Artificial Sequence: Synthetic polypeptide
DIQMTQSPSSLSASVGDRVTITCSVSSSVSSIYLHWYQQKPGKAPKLLIYSTSNLASGVPSRFSGSGSGTDFTLTISSLQPEDFATYYCQVYSGYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205031 - protein, 449 aa, Artificial Sequence
  Description of Artificial Sequence: Synthetic polypeptide
EVQLVESGGGLVQPGGSLRLSCAASGFTFSSYWMSWVRQAPGKGLEWVAEIRLKSDNYATHYAESVKGRFTISRDDSKNSLYLQMNSLRAEDTAVYYCTGYYADAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205032 - protein, 218 aa, Artificial Sequence
  Description of Artificial Sequence: Synthetic polypeptide
DIQMTQSPSSLSASVGDRVTITCRASQSVSTSSYSYMHWYQQKPGKAPKLLIKYASNLESGVPSRFSGSGSGTDFTLTISSLQPEDFATYYCQHSWEIPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205033 - protein, 447 aa, Artificial Sequence
  Description of Artificial Sequence: Synthetic polypeptide
EVQLVESGGGLVQPGGSLRLSCAASGFTFSSYNMNWVRQAPGKGLEWVSYISSSSSTIYYADSVKGRFTISRDNAKNSLSLQMNSLRDEDTAVYYCARAYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205034 - protein, 214 aa, Artificial Sequence
  Description of Artificial Sequence: Synthetic polypeptide
DIQMTQSPSSVSASVGDRVTITCRASQGISGWLAWYQQKPGKAPKFLIYAASTLQSGVPSRFSGSGSGTDFTLTISSLQPEDFATYYCQQANSFPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205035 - protein, 446 aa, Artificial Sequence
  Description of Artificial Sequence: Synthetic polypeptide
EVQLVESGGGLVQPGGSLRLSCAASGFTFSSYNMNWVRQAPGKGLEWVSYISSSSSTIYYADSVKGRFTISRDNAKNSLSLQMNSLRDEDTAVYYCARAYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205036 - protein, 214 aa, Artificial Sequence; identical to SEQ ID NO: 205034
  Description of Artificial Sequence: Synthetic polypeptide

SEQ ID NO: 205037 - protein, 36 aa, Artificial Sequence
  Description of Artificial Sequence: Synthetic polypeptide
FWNWLSAWKDLELLEQENKEQQNQSEEILSHILSTY

SEQ ID NO: 205038 - protein, 452 aa, Artificial Sequence
  Description of Artificial Sequence: Synthetic polypeptide
EVQLVESGGGLVQPGGSLRLSCAASGFTFSSFGMHWVRQAPGKGLEWVAYISSDSSAIYYADTVKGRFTISRDNAKNSLYLQMNSLRDEDTAVYYCGRGRENIYYGSRLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELVGGPSVFLLPPKPKDTLMISRTPEVTCVVVDVSHEDPEVKFNWYVDGVEVHNAKTKPPEEQYNSTLRVVSVLTVLHQDWLNGKEYKCKVSNKALPAPIEKTISKAKGQPREPQVYTLPPSREEMTKNQVSLTCLVKGFYPSDIAVEWESNGQPENNYKTTPLVLDSDGSFFLYSKLTVDKSRWQQGNVFSCSVMHEALHNHYTQKSLSLSPGK

SEQ ID NO: 205039 - protein, 214 aa, Artificial Sequence
  Description of Artificial Sequence: Synthetic polypeptide
DIQLTQSPSFLSASVGDRVTITCKASQNVDTNVAWYQQKPGKAPKALIYSASYRYSGVPSRFSGSGSGTDFTLTISSLQPEDFATYYCQQYNNYPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205040 - protein, 452 aa, Artificial Sequence
  Description of Artificial Sequence: Synthetic polypeptide
QVQLVQSGAEVKKPGSSVKVSCKASGGTFSYYWIEWVRQAPGQGLEWMGEILPGSGTTNPNEKFKGRVTITADESTSTAYMELSSLRSEDTAVYYCARADYYGSDYVKFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205041 - protein, 204 aa, Artificial Sequence
  Description of Artificial Sequence: Synthetic polypeptide
DIQMTQSPSSLSASVGDRVTITCKASQHVITHVTWYQQKPGKAPKLLIYGTSYSYSGVPSRFSGSGSGTDFTLTISSLQPEDFATYYCQQFYEYPLTFGGGTKVEIKRTVAAPSVFIFPPSDEQLKSGTASVVCLLNNFYPREAKVQWKVESVTEQDSKDSTYSLSSTLTLSKADYEKHKVYACEVTHQGLSSPVTKSFNRGEC

SEQ ID NO: 205042 - protein, 452 aa, Artificial Sequence
  Description of Artificial Sequence: Synthetic polypeptide
QVQLVESGGGVVQPGRSLRLSCAASGFTFSSYGMHWVRQAPGKGLEWVSFLWYDGTNKNYVESVKGRFTISRDNSKNMLYLEMNSLRAEDTAVYYCARDHDFRSGYEGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205043 - protein, 214 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQHRSNWPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205044 - protein, 443 aa, Artificial Sequence
  Description of Artificial Sequence: Synthetic polypeptide
QVQLKESGPDLVAPSQSLSITCTVSGFSLSKFGVNWVRQPPGKGLEWLGVIWGDGSTSYNSGLISRLSISKENSKSQVFLKLNSLQADDTATYYCVKPGGDYWGHGTSVTVSSASTKGPSVFPLAPSSKSTSGGTAALGCLVKDYFPEPVTVSWNSGALTSGVHTFPAVLQSSGPYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTMPPVLDSDGSFFLYSKLTVDKSRWQQGNVFSCSVMHEALHNHYTQKSLSLSPGK

SEQ ID NO: 205045 - protein, 213 aa, Artificial Sequence
  Description of Artificial Sequence: Synthetic polypeptide
QVVLTQSPVIMSASPGEKVTMTCSASSSISYMYWYQQKPGTSPKRWIYDTSKLASGVPARFSGSGSGTSYSLTISNMEAGDAATYYCHQRDSYPWTFGGGTNLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205046 - protein, 193 aa, Artificial Sequence; identical to SEQ ID NO: 28186
  Description of Artificial Sequence: Synthetic polypeptide

SEQ ID NO: 205047 - protein, 193 aa, Artificial Sequence; identical to SEQ ID NO: 28186
  Description of Artificial Sequence: Synthetic polypeptide

SEQ ID NO: 205048 - protein, 447 aa, Artificial Sequence
  Description of Artificial Sequence: Synthetic polypeptide
QVQLVESGGGVVQPGRSLRLSCAASGFTFSSYDMSWVRQAPGKGLEWVAKVSSGGGSTYYLDTVQGRFTISRDNSKNTLYLQMNSLRAEDTAVYYCARHLHGSFASWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205049 - protein, 214 aa, Artificial Sequence
  Description of Artificial Sequence: Synthetic polypeptide
EIVLTQSPATLSLSPGERATLSCQASQSISNFLHWYQQRPGQAPRLLIRYRSQSISGIPARFSGSGSGTDFTLTISSLEPEDFAVYYCQQSGSWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205050 - protein, 446 aa, Artificial Sequence
  Description of Artificial Sequence: Synthetic polypeptide
EVQLVESGGGLVQPGGSLRLSCAASGFFITNNYWGWVRQAPGKGLEWVGYISYSGSTSYNPSLKSRFTISRDTSKNTFYLQMNSLRAEDTAVYYCARTGSSGYFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205051 - protein, 214 aa, Artificial Sequence
  Description of Artificial Sequence: Synthetic polypeptide
DIQMTQSPSSLSASVGDRVTITCRASESVDDLLHWYQQKPGKAPKLLIKYASQSISGVPSRFSGSGSGTDFTLTISSLQPEDFATYYCQQGNSLPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205052 - protein, 453 aa, Artificial Sequence
  Description of Artificial Sequence: Synthetic polypeptide
EVQLVESGGGVIQPGGSLRLSCAASGFTFDDYAMNWVRQGPGKGLEWVSAISGDGGSTYYADSVKGRFTISRDNSKNSLYLQMNSLRAEDTAFFYCAKDLRNTIFGVVIPDAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205053 - protein, 214 aa, Artificial Sequence
  Description of Artificial Sequence: Synthetic polypeptide
DIQMTQSPSTLSASVGDRVTITCRASQSIRSWLAWYQQKPGKAPKLLIYKASSLESGVPSRFSGSGSGTEFTLTISSLQPDDFATYYCQQYNSYSYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205054 - protein, 449 aa, Artificial Sequence
  Description of Artificial Sequence: Synthetic polypeptide
EVQLVESGGGVVQPGRSLRLSCSASGFTFSGYGLSWVRQAPGKGLEWVAMISSGGSYTYYADSVKGRFAISRDNAKNTLFLQMDSLRPEDTGVYFCARHGDDPAWFAYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205055 - protein, 217 aa, Artificial Sequence
  Description of Artificial Sequence: Synthetic polypeptide
DIQLTQSPSSLSASVGDRVTITCSVSSSISSNNLHWYQQKPGKAPKPWIYGTSNLASGVPSRFSGSGSGTDYTFTISSLQPEDIATYYCQQWSSYPYMYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205056 - protein, 446 aa, Artificial Sequence
  Description of Artificial Sequence: Synthetic polypeptide
QVQLVQSGAEVKKPGASVKVSCKVSGFTLTELSIHWVRQAPGKGLEWMGGFDPEDGETIYAQKFQGRVTMTEDTSTDTAYMELTSLRSEDTAVYYCSTIFGVVTNFDNWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205057 - protein, 214 aa, Artificial Sequence
  Description of Artificial Sequence: Synthetic polypeptide
DIQMTQSPSSLSASAGDRVTITCRASQAIRNDLGWYQQKPGKAPKRLIYAAFNLQSGVPSRFSGSGSGTEFTLTISSLQPEDLASYYCQQYNRYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205058 - protein, 450 aa, Artificial Sequence
  Description of Artificial Sequence: Synthetic polypeptide
QVQLVQSGAEVKKPGASVKVSCKASGYTFTNYYMHWVRQAPGQGLEWVGWINPYTGSAFYAQKFRGRVTMTRDTSISTAYMELSRLRSDDTAVYYCAREPEKFDSDDSDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205059 - protein, 217 aa, Artificial Sequence
  Description of Artificial Sequence: Synthetic polypeptide
QAVLTQPPSVSGAPGQRVTISCTGSSSNIGAGYGVHWYQQLPGTAPKLLIYGDSNRPSGVPDRFSGSKSGTSASLAITGLQAEDEADYYCQSYDNSLSGYVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 205060 - protein, 866 aa, Artificial Sequence; identical to SEQ ID NO: 31794
  Description of Artificial Sequence: Synthetic polypeptide

SEQ ID NO: 205061 - protein, 447 aa, Artificial Sequence
  Description of Artificial Sequence: Synthetic polypeptide
VQLVQPGAEVKKPGTSVKLSCKASGYTFTTYWMHWVRQAPGQGLEWIGEINPTNGHTNYNQKFQGRATLTVDKSTSTAYMELSSLRSEDTAVYYCARNYVGSIFDYWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205062 - protein, 214 aa, Artificial Sequence
  Description of Artificial Sequence: Synthetic polypeptide
DIVMTQSPDSLAMSLGERVTLNCKASENVVSYVSWYQQKPGQSPKLLIYGASNRESGVPDRFSGSGSATDFTLTISSVQAEDVADYHCGQSYNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205063 - protein, 450 aa, Artificial Sequence
  Description of Artificial Sequence: Synthetic polypeptide
EVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 205064 - protein, 214 aa, Artificial Sequence
  Description of Artificial Sequence: Synthetic polypeptide
DIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205065 - protein, 449 aa, Artificial Sequence
  Description of Artificial Sequence: Synthetic polypeptide
QVQLVQSGSELKKPGASVKISCKASGYTFTSYAMNWVRQAPGQGLESMGWINTNTGNPTYAQGFTGRFVFSMDTSVSTAYLQISSLKAEDTAIYYCAPRYSSSWYLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205066 - protein, 215 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWLMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205067 - protein, 454 aa, Artificial Sequence
  Description of Artificial Sequence: Synthetic polypeptide
QVQLVQSGAEVKRPGASVKVSCKASGYTFTNDIIHWVRQAPGQRLEWMGWINAGYGNTQYSQNFQDRVSITRDTSASTAYMELISLRSEDTAVYYCAREPLWFGESSPHDYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205068 - protein, 214 aa, Artificial Sequence
  Description of Artificial Sequence: Synthetic polypeptide
AIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205069 - protein, 129 aa, Artificial Sequence; identical to SEQ ID NO: 32478
  Description of Artificial Sequence: Synthetic polypeptide

SEQ ID NO: 205070 - protein, 129 aa, Artificial Sequence; identical to SEQ ID NO: 32478
  Description of Artificial Sequence: Synthetic polypeptide

SEQ ID NO: 205071 - protein, 129 aa, Artificial Sequence; identical to SEQ ID NO: 32478
  Description of Artificial Sequence: Synthetic polypeptide

SEQ ID NO: 205072 - protein, 448 aa, Artificial Sequence
  Description of Artificial Sequence: Synthetic polypeptide
QVQLVESGGGVVQPGRSLRLSCAASGFKFSGYGMHWVRQAPGKGLEWVAVIWYDGSKKYYVDSVKGRFTISRDNSKNTLYLQMNSLRAEDTAVYYCARQMGYWHFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205073 - protein, 215 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205074 - protein, 448 aa, Artificial Sequence
  Description of Artificial Sequence: Synthetic polypeptide
EVQLVESGGGAVQPGRSLRLSCAASGFTFSSYGMHWVRQAPGKGLEWVAVILYDGSDKFYADSVKGRFTISRDNSKNTLYLQMNSLRAEDTAVYYCAKVAVAGTHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205075 - protein, 214 aa, Artificial Sequence
  Description of Artificial Sequence: Synthetic polypeptide
DIQMTQSPSSLSASVGDRVTITCRASQGIRNDLGWYQQKPGKAPKLLIYAASSLQSGVPSRFSGSGSGTDFTLTISSLQPEDFATYYCQQLNSYPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205076 - protein, 447 aa, Artificial Sequence
  Description of Artificial Sequence: Synthetic polypeptide
QVQLVQSGAEVKKPGSSVKVSCKASGYTFSSNVISWVRQAPGQGLEWMGGVIPIVDIANYAQRFKGRVTITADESTSTTYMELSSLRSEDTAVYYCASTLGLVLDAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205077 - protein, 215 aa, Artificial Sequence
  Description of Artificial Sequence: Synthetic polypeptide
ETVLTQSPGTLSLSPGERATLSCRASQSLGSSYLAWYQQKPGQAPRLLIYGASSRAPGIPDRFSGSGSGTDFTLTISRLEPEDFAVYYCQQYADSPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205078 - protein, 449 aa, Artificial Sequence
  Description of Artificial Sequence: Synthetic polypeptide
EVQLVESGGGLVQPGGSLRLSCAASGFTLRSYSMNWVRQAPGKGLEWVSYISRSSHTIFYADSVKGRFTISRDNAKNSLYLQMDSLRDEDTAMYYCARVYSSGWHVSDYFDYWGQGILVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 205079 - protein, 214 aa, Artificial Sequence; identical to SEQ ID NO: 205068
  Description of Artificial Sequence: Synthetic polypeptide

SEQ ID NO: 205080 - protein, 335 aa, Artificial Sequence
  Description of Artificial Sequence: Synthetic polypeptide
ETRECIYYNANWELERTNQSGLERCEGEQDKRLHCYASWRNSSGTIELVKKGCWDDDFNCYDRQECVATEENPQVYFCCCEGNFCNERFTHLPEAGGPEVTYEPPPTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205081 - protein, 452 aa, Artificial Sequence
  Description of Artificial Sequence: Synthetic polypeptide
EVQLQQPGSELVRPGASVKLSCKASGYTFTSYWMHWVKQRPGQGLEWIGNIYPGSRSTNYDEKFKSKATLTVDTSSSTAYMQLSSLTSEDSAVYYCTRNGDYYVSSGDAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205082 - protein, 214 aa, Artificial Sequence
  Description of Artificial Sequence: Synthetic polypeptide
DIQMTQTTSSLSASLGDRVTISCRTSQDIGNYLNWYQQKPDGTVKLLIYYTSRLHSGVPSRFSGSGSGTDFSLTINNVEQEDVATYFCQHYNTVPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205083 - protein, 456 aa, Artificial Sequence
  Description of Artificial Sequence: Synthetic polypeptide
QVELVESGGGLVQPGGSLRLSCAASGFTFSSYAMSWVRQAPGKGLEWVSAINASGTRTYYADSVKGRFTISRDNSKNTLYLQMNSLRAEDTAVYYCARGKGNTHKPYGYVRYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205084 - protein, 215 aa, Artificial Sequence
  Description of Artificial Sequence: Synthetic polypeptide
DIVLTQSPATLSLSPGERATLSCRASQSVSSSYLAWYQQKPGQAPRLLIYGASSRATGVPARFSGSGSGTDFTLTISSLEPEDFATYYCLQIYNMPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205085 - protein, 445 aa, Artificial Sequence
  Description of Artificial Sequence: Synthetic polypeptide
QVQLQESGPGLVKPSQTLSLTCSFSGFSLSTSGMGVGWIRQPSGKGLEWLAHIWWDGDESYNPSLKSRLTISKDTSKNQVSLKITSVTAADTAVYFCARNRYDPPWFVDWGQGTLVTVSSASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 205086 - protein, 214 aa, Artificial Sequence
  Description of Artificial Sequence: Synthetic polypeptide
DIQMTQSTSSLSASVGDRVTITCRASQDISNYLSWYQQKPGKAVKLLIYYTSKLHSGVPSRFSGSGSGTDYTLTISSLQQEDFATYFCLQGKMLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205087 - protein, 449 aa, Artificial Sequence
  Description of Artificial Sequence: Synthetic polypeptide
DVKLVESGGGLVKLGGSLKLSCAASGFTFSNYYMSWVRQTPEKRLELVAAINSDGGITYYLDTVKGRFTISRDNAKNTLYLQMSSLKSEDTALFYCARHRSGYFSMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205088 - protein, 214 aa, Artificial Sequence
  Description of Artificial Sequence: Synthetic polypeptide
DIVMTQSQRFMSTTVGDRVSITCKASQNVVSAVAWYQQKPGQSPKLLIYSASNRYTGVPDRFTGSGSGTDFTLTISNMQSEDLADFFCQQYSNYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205089 - protein, 445 aa, Artificial Sequence
  Description of Artificial Sequence: Synthetic polypeptide
QVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 205090 - protein, 215 aa, Artificial Sequence
  Description of Artificial Sequence: Synthetic polypeptide
EIVMTQSPATLSVSPGERATLSCRASQSVDNNLVWYQQKPGQAPRLLIYGASTRATGIPARFSGSGSGTEFTLTISSLQSEDFAVYYCQQYNNWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205091 - protein, 180 aa, Artificial Sequence
  Description of Artificial Sequence: Synthetic polypeptide
MKSIYFVAGLFVMLVQGSWQQDTEEKSRSLRSFSASQADPLSDPDQMNEDKRHSQGTFTSDYSKYLDSRRAQDFVQWLMNTKRNRNNIAKRHDEFERHAEGTFTSDVSSYLEGQAAKEFIAWLVKGRGRRDFPEEVAIVEELGRRHADGSFSDEMNTILDNLAARDFINWLIQTKITDRK

SEQ ID NO: 205092 - protein, 180 aa, Artificial Sequence; identical to SEQ ID NO: 205091
  Description of Artificial Sequence: Synthetic polypeptide

SEQ ID NO: 205093 - protein, 536 aa, Artificial Sequence
  Description of Artificial Sequence: Synthetic polypeptide
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWHRQ

SEQ ID NO: 205094 - protein, 536 aa, Artificial Sequence; identical to SEQ ID NO: 205093
  Description of Artificial Sequence: Synthetic polypeptide

SEQ ID NO: 205095 - protein, 92 aa, Artificial Sequence
  Description of Artificial Sequence: Synthetic polypeptide
APDVQDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 205096 - protein, 92 aa, Artificial Sequence; identical to SEQ ID NO: 205095
  Description of Artificial Sequence: Synthetic polypeptide

SEQ ID NO: 205097 - protein, 207 aa, Artificial Sequence; identical to SEQ ID NO: 19234
  Description of Artificial Sequence: Synthetic polypeptide

SEQ ID NO: 205098 - protein, 207 aa, Artificial Sequence; identical to SEQ ID NO: 19234
  Description of Artificial Sequence: Synthetic polypeptide

SEQ ID NO: 205099 - protein, 127 aa, Artificial Sequence
  Description of Artificial Sequence: Synthetic polypeptide
APARSPSPSTQPWEHVNAIQEALRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 205100 - protein, 497 aa, Artificial Sequence
  Description of Artificial Sequence: Synthetic polypeptide
ARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 205101 - protein, 896 aa, Artificial Sequence
  Description of Artificial Sequence: Synthetic polypeptide
QQGASRPGPRDAQAHPGRPRAVPTQCDVPPNSRFDCAPDKAITQEQCEARGCCYIPAKQGLQGAQMGQPWCFFPPSYPSYKLENLSSSEMGYTATLTRTTPTFFPKDILTLRLDVMMETENRLHFTIKDPANRRYEVPLETPRVHSRAPSPLYSVEFSEEPFGVIVHRQLDGRVLLNTTVAPLFFADQFLQLSTSLPSQYITGLAEHLSPLMLSTSWTRITLWNRDLAPTPGANLYGSHPFYLALEDGGSAHGVFLLNSNAMDVVLQPSPALSWRSTGGILDVYIFLGPEPKSVVQQYLDVVGYPFMPPYWGLGFHLCRWGYSSTAITRQVVENMTRAHFPLDVQWNDLDYMDSRRDFTFNKDGFRDFPAMVQELHQGGRRYMMIVDPAISSSGPAGSYRPYDEGLRRGVFITNETGQPLIGKVWPGSTAFPDFTNPTALAWWEDMVAEFHDQVPFDGMWIDMNEPSNFIRGSEDGCPNNELENPPYVPGVVGGTLQAATICASSHQFLSTHYNLHNLYGLTEAIASHRALVKARGTRPFVISRSTFAGHGRYAGHWTGDVWSSWEQLASSVPEILQFNLLGVPLVGADVCGFLGNTSEELCVRWTQLGAFYPFMRNHNSLLSLPQEPYSFSEPAQQAMRKALTLRYALLPHLYTLFHQAHVAGETVARPLFLEFPKDSSTWTVDHQLLWGEALLITPVLQAGKAEVTGYFPLGTWYDLQTVPIEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLLMGEQFLVSWC

SEQ ID NO: 205102 - protein, 449 aa, Artificial Sequence
  Description of Artificial Sequence: Synthetic polypeptide
QVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205103 - protein, 219 aa, Artificial Sequence
  Description of Artificial Sequence: Synthetic polypeptide
DIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205104 - protein, 456 aa, Artificial Sequence
  Description of Artificial Sequence: Synthetic polypeptide
QAQVVESGGGVVQSGRSLRLSCAASGFAFSSYGMHWVRQAPGKGLEWVAVIWYDGSNKYYADSVRGRFTISRDNSENTLYLQMNSLRAEDTAVYYCARDHYGSGVHHYFYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205105 - protein, 215 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205106 - protein, 235 aa, Artificial Sequence
  Description of Artificial Sequence: Synthetic polypeptide
HEAVYCHAINQVQLQESGPGLVKPSETLSLTCTVSGFSLTSYIVDWIRQPPGKGLEWIGVIWAGGSTGYNSALRSRVSITKDTSKNQFSLKLSSVTAADTAVYYCASAAYYSYYNYDGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 205107 - protein, 219 aa, Artificial Sequence
  Description of Artificial Sequence: Synthetic polypeptide
DVVMTQSPLSLPVTLGQPASISCKSSQSLLYTDGKTYLYWFLQRPGQSPRRLIYLVSKLDSGVPDRFSGSGSGTDFTLKISRVEAEDVGVYYCLQSTHFPHTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205108 - protein, 449 aa, Artificial Sequence
  Description of Artificial Sequence: Synthetic polypeptide
QVQLVQSGAEVKKPGSSVKVSCKASGFTFTDYKIHWVRQAPGQGLEWMGYFNPNSGYSTYAQKFQGRVTITADKSTSTAYMELSSLRSEDTAVYYCARLSPGGYYVMDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205109 - protein, 213 aa, Artificial Sequence
  Description of Artificial Sequence: Synthetic polypeptide
DIQMTQSPSSLSASVGDRVTITCRASQGINNYLNWYQQKPGKAPKRLIYNTNNLQTGVPSRFSGSGSGTEFTLTISSLQPEDFATYYCLQHNSFPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205110 - protein, 451 aa, Artificial Sequence
  Description of Artificial Sequence: Synthetic polypeptide
EVQLVESGGGLVRPGGSLRLSCAASGFTFSNYDMHWVRQATGKGLEWVSAITAAGDIYYPGSVKGRFTISRENAKNSLYLQMNSLRAGDTAVYYCARGRYSGSGSYYNDWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205111 - protein, 214 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205112 - protein, 449 aa, Artificial Sequence
  Description of Artificial Sequence: Synthetic polypeptide
QVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205113 - protein, 214 aa, Artificial Sequence
  Description of Artificial Sequence: Synthetic polypeptide
DIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205114 - protein, 70 aa, Artificial Sequence
  Description of Artificial Sequence: Synthetic polypeptide
GPETLCGAELVDALQFVCGDRGFYFNKPTGYGSSSRRAPQTGIVDECCFRSCDLRRLEMYCAPLKPAKSA

SEQ ID NO: 205115 - protein, 70 aa, Artificial Sequence; identical to SEQ ID NO: 205114
  Description of Artificial Sequence: Synthetic polypeptide

SEQ ID NO: 205116 - protein, 264 aa, Artificial Sequence
  Description of Artificial Sequence: Synthetic polypeptide
GASSGGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 205117 - protein, 188 aa, Artificial Sequence [sequence omitted]

SEQ ID NO: 205118 - protein, 188 aa, Artificial Sequence [sequence omitted]

SEQ ID NO: 205119 - protein, 188 aa, Artificial Sequence [sequence omitted]

SEQ ID NO: 205120 - protein, 188 aa, Artificial Sequence [sequence omitted]

SEQ ID NO: 205121 - protein, 187 aa, Artificial Sequence; identical to SEQ ID NO: 41210
  Description of Artificial Sequence: Synthetic polypeptide

SEQ ID NO: 205122 - protein, 187 aa, Artificial Sequence; identical to SEQ ID NO: 41210
  Description of Artificial Sequence: Synthetic polypeptide

SEQ ID NO: 205123 - protein, 166 aa, Artificial Sequence; identical to SEQ ID NO: 41212
  Description of Artificial Sequence: Synthetic polypeptide

SEQ ID NO: 205124 - protein, 177 aa, Artificial Sequence; identical to SEQ ID NO: 41299
  Description of Artificial Sequence: Synthetic polypeptide

SEQ ID NO: 205125 - protein, 199 aa, Artificial Sequence; identical to SEQ ID NO: 41339
  Description of Artificial Sequence: Synthetic polypeptide

SEQ ID NO: 205126 - protein, 153 aa, Artificial Sequence; identical to SEQ ID NO: 41474
  Description of Artificial Sequence: Synthetic polypeptide

SEQ ID NO: 205127 - protein, 449 aa, Artificial Sequence
  Description of Artificial Sequence: Synthetic polypeptide
QVQLVESGGGVVQPGRSRRLSCAASGFTFSRYTMHWVRQAPGKGLEWVAVISFDGSNKYYVDSVKGRFTISRDNSENTLYLQVNILRAEDTAVYYCAREARGSYAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205128 - protein, 215 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205129 - protein, 450 aa, Artificial Sequence
  Description of Artificial Sequence: Synthetic polypeptide
QVQLKESGPGLVAPSQSLSITCTVSGFSLTDYGVRWIRQPPGKGLEWLGVIWGGGSTYYNSALKSRLSISKDNSKSQVFLKMNSLQTDDTAMYYCAKEKRRGYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205130 - protein, 215 aa, Artificial Sequence
  Description of Artificial Sequence: Synthetic polypeptide
ENVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205131 - protein, 362 aa, Artificial Sequence
  Description of Artificial Sequence: Synthetic polypeptide
ASAKELACQEITVPLCKGIGYNYTYMPNQFNHDTQDEAGLEVHQFWPLVEIQCSPDLKFFLCSMYTPICLEDYKKPLPPCRSVCERAKAGCAPLMRQYGFAWPDRMRCDRLPEQGNPDTLCMDYNRTDLTTEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205132 - protein, 450 aa, Artificial Sequence
  Description of Artificial Sequence: Synthetic polypeptide
QVQLVQSGAEVAKPGTSVKLSCKASGYTFTDYWMQWVKQRPGQGLEWIGTIYPGDGDTGYAQKFQGKATLTADKSSKTVYMHLSSLASEDSAVYYCARGDYYGSNSLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205133 - protein, 214 aa, Artificial Sequence
  Description of Artificial Sequence: Synthetic polypeptide
DIVMTQSHLSMSTSLGDPVSITCKASQDVSTVVAWYQQKPGQSPRRLIYSASYRYIGVPDRFTGSGAGTDFTFTISSVQAEDLAVYYCQQHYSPPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205134 - protein, 153 aa, Artificial Sequence
  Description of Artificial Sequence: Synthetic polypeptide
APVRSLNCRIWDVNQKTFYLRNNQLVAGYLQGPNVNLEEKFSMSFVQGEESNDKIPVALGLKEKNLYLSCVLKDDKPTLQLESVDPKNYPKKKMEKRFVFNKIEINNKLEFESAQFPNWFLCTAMEADQPVSLTNMPDEGVMVTKFYMQFVSS

SEQ ID NO: 205135 - protein, 449 aa, Artificial Sequence
  Description of Artificial Sequence: Synthetic polypeptide
EVQLVESGGGLVKPGGSLKLSCAASGFKFSRYAMSWVRQAPGKRLEWVATISSGGSYIYYPDSVKGRFTISRDNVKNTLYLQMSSLRSEDTAMYYCARRDYDLDYFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205136 - protein, 214 aa, Artificial Sequence
  Description of Artificial Sequence: Synthetic polypeptide
DIQMTQSPSSLSASVGDRVTITCKASRDIRSYLTWYQQKPGKAPKTLIYYATSLADGVPSRFSGSGSGQDYSLTISSLESDDTATYYCLQHGESPFTLGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205137 - protein, 445 aa, Artificial Sequence
  Description of Artificial Sequence: Synthetic polypeptide
QVQLVQSGAEVKKPGSSVKVSCKASGYSFTDYHIHWVRQAPGQGLEWMGVINPMYGTTDYNQRFKGRVTITADESTSTAYMELSSLRSEDTAVYYCARYDYFTGTGVYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 205138 - protein, 219 aa, Artificial Sequence
  Description of Artificial Sequence: Synthetic polypeptide
DIVMTQTPLSLSVTPGQPASISCRSSRSLVHSRGNTYLHWYLQKPGQSPQLLIYKVSNRFIGVPDRFSGSGSGTDFTLKISRVEAEDVGVYYCSQSTHLPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205139 - protein, 449 aa, Artificial Sequence
  Description of Artificial Sequence: Synthetic polypeptide
EVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205140 - protein, 213 aa, Artificial Sequence
  Description of Artificial Sequence: Synthetic polypeptide
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205141 - protein, 223 aa, Artificial Sequence
  Description of Artificial Sequence: Synthetic polypeptide
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 205142 - protein, 214 aa, Artificial Sequence
  Description of Artificial Sequence: Synthetic polypeptide
DIQVTQSPSSLSASVGDRVTITCITSTDIDDDMNWYQQKPGKVPKLLISGGNTLRPGVPSRFSGSGSGTDFTLTISSLQPEDVATYYCLQSDSLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205143 - protein, 451 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205144 - protein, 213 aa, Artificial Sequence
  Description of Artificial Sequence: Synthetic polypeptide
DIQMTQSPSTLSASVGDRVTITCRASQSISSWLAWYQQKPGKAPKLLIYKASTLESGVPSRFSGSGSGTEFTLTISSLQPDDFATYYCQQYNTYWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205145 - protein, 439 aa, Artificial Sequence
  Description of Artificial Sequence: Synthetic polypeptide
EVQLVESGGGLVQPGGSLRLSCAASGLTFSRYPMSWVRQAPGKGLVWVSAITSSGGSTYYSDTVKGRFTISRDNAKNTLYLQMNSLRAEDTAVYYCARLPDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 205146 - protein, 215 aa, Artificial Sequence
  Description of Artificial Sequence: Synthetic polypeptide
EIVLTQSPGTLSLSPGERATLSCRASSSVSSSYLHWYQQKPGQAPRLLIYSTSNLVAGIPDRFSGSGSGTDFTLTISRLEPEDFAVYYCQHHSGYHFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205147 - protein, 445 aa, Artificial Sequence
  Description of Artificial Sequence: Synthetic polypeptide
QVTLRESGPALVKPTQTLTLTCTVSGFSLSAYSVNWIRQPPGKALEWLAMIWGDGKIVYNSALKSRLTISKDTSKNQVVLTMTNMDPVDTATYYCAGDGYYPYAMDNWGQGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205148 - protein, 218 aa, Artificial Sequence
  Description of Artificial Sequence: Synthetic polypeptide
DIVMTQSPDSLSVSLGERATINCRASKSVDSYGNSFMHWYQQKPGQPPKLLIYLASNLESGVPDRFSGSGSGTDFTLTISSLQAEDVAVYYCQQNNEDPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205149 - protein, 451 aa, Artificial Sequence
  Description of Artificial Sequence: Synthetic polypeptide
EVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205150 - protein, 214 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 205151 - protein, 450 aa, Artificial Sequence
  Description of Artificial Sequence: Synthetic polypeptide
EVQLVESGGGLVQPGGSLRLSCAASGFSFSDFAMSWVRQAPGKGLEWVATIGRVAFHTYYPDSMKGRFTISRDNSKNTLYLQMNSLRAEDTAVYYCARHRGFDVGHFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205152 - protein, 219 aa, Artificial Sequence
  Description of Artificial Sequence: Synthetic polypeptide
DIQMTQSPSSLSASVGDRVTITCRSSETLVHSSGNTYLEWYQQKPGKAPKLLIYRVSNRFSGVPSRFSGSGSGTDFTLTISSLQPEDFATYYCFQGSFNPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205153 - protein, 453 aa, Artificial Sequence
  Description of Artificial Sequence: Synthetic polypeptide
QVQLVQSGAEVMKPGSSVKVSCKASGYTFSWYWLEWVRQAPGHGLEWMGEIDPGTFTTNYNEKFKARVTFTADTSTSTAYMELSSLRSEDTAVYYCARFSHFSGSNYDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205154 - protein, 214 aa, Artificial Sequence
  Description of Artificial Sequence: Synthetic polypeptide
EIVMTQSPATLSVSPGERATLSCRASQSIGTNIHWYQQKPGQAPRLLIYYASESISGIPARFSGSGSGTEFTLTISSLQSEDFAVYYCQQSWSWPTTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205155 - protein, 450 aa, Artificial Sequence
  Description of Artificial Sequence: Synthetic polypeptide
QVQLVQSGAEVKKPGSSVKVSCKASGGTFSFYAISWVRQAPGQGLEWMGGFIPIFGAANYAQKFQGRVTITADESTSTAYMELSSLRSDDTAVYYCARIPSGSYYYDYDMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205156 - protein, 214 aa, Artificial Sequence
  Description of Artificial Sequence: Synthetic polypeptide
EIVLTQSPVTLSLSPGERATLSCRASQSVSSYLAWYQQKPGQAPRLLIYDASNRATGIPARFSGSGSGTDFTLTISSLEPEDFAVYYCQQRSNWMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205157 - protein, 448 aa, Artificial Sequence
  Description of Artificial Sequence: Synthetic polypeptide
QVQLVESGGGVVQPGRSLRLSCAASGFTFSSFGMHWVRQAPGKGLEWVAYISSGSFTIYYADSVKGRFTISRDNSKNTLYLQMNSLRAEDTAVYYCARMRKGYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205158 - protein, 219 aa, Artificial Sequence
  Description of Artificial Sequence: Synthetic polypeptide
DVVMTQSPLSLPVTLGQPASISCRSSQIIIHSDGNTYLEWFQQRPGQSPRRLIYKVSNRFSGVPDRFSGSGSGTDFTLKISRVEAEDVGVYYCFQGSHVPHTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205159 - protein, 450 aa, Artificial Sequence
  Description of Artificial Sequence: Synthetic polypeptide
QVQLVESGGGVVQPGRSLRLSCAASGFTFSSYGMHWVRQAPGKGLEWVAVISYEESNRYHADSVKGRFTISRDNSKITLYLQMNSLRTEDTAVYYCARDGGIAAPGPDYWGQGTLVTVSSASTKGPSVFPLAPASKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205160 - protein, 219 aa, Artificial Sequence
  Description of Artificial Sequence: Synthetic polypeptide
DIVMTQSPLSLTVTPGEPASISCRSSQSLLYSNGYNYLDWYLQKPGQSPQVLISLGSNRASGVPDRFSGSGSGTDFTLKISRVEAEDVGVYYCMQARQTPFTFGPGTKVDIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205161 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLRHGVPSRFSGSGSGTCFTLTISSLQPEDFATYYCLQNVANPATFSQGTKVEIKR

SEQ ID NO: 205162 - protein, 141 aa, Artificial Sequence; identical to SEQ ID NO: 47375
  Description of Artificial Sequence: Synthetic polypeptide

SEQ ID NO: 205163 - protein, 141 aa, Artificial Sequence; identical to SEQ ID NO: 47375
  Description of Artificial Sequence: Synthetic polypeptide

SEQ ID NO: 205164 - protein, 447 aa, Artificial Sequence
  Description of Artificial Sequence: Synthetic polypeptide
QVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205165 - protein, 217 aa, Artificial Sequence
  Description of Artificial Sequence: Synthetic polypeptide
QSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 205166 - protein, 450 aa, Artificial Sequence
  Description of Artificial Sequence: Synthetic polypeptide
QVQLQQSGSELKKPGASVKVSCKASGYTFTNYGVNWIKQAPGQGLQWMGWINPNTGEPTFDDDFKGRFAFSLDTSVSTAYLQISSLKADDTAVYFCSRSRGKNEAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205167 - protein, 219 aa, Artificial Sequence
  Description of Artificial Sequence: Synthetic polypeptide
DIQLTQSPLSLPVTLGQPASISCRSSQSLVHRNGNTYLHWFQQRPGQSPRLLIYTVSNRFSGVPDRFSGSGSGTDFTLKISRVEAEDVGVYFCSQSSHVPPTFGAGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205168 - protein, 447 aa, Artificial Sequence
  Description of Artificial Sequence: Synthetic polypeptide
QVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205169 - protein, 218 aa, Artificial Sequence
  Description of Artificial Sequence: Synthetic polypeptide
DIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205170 - protein, 449 aa, Artificial Sequence
  Description of Artificial Sequence: Synthetic polypeptide
EVQLVESGGDLVQPGRSLRLSCAASGFIFSNYGMSWVRQAPGKGLEWVATISSASTYSYYPDSVKGRFTISRDNAKNSLYLQMNSLRVEDTALYYCGRHSDGNFAFGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205171 - protein, 219 aa, Artificial Sequence
  Description of Artificial Sequence: Synthetic polypeptide
DVLMTQSPLSLPVTPGEPASISCRSSRNIVHINGDTYLEWYLQKPGQSPQLLIYKVSNRFSGVPDRFSGSGSGTDFTLKISRVEAEDVGVYYCFQGSLLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205172 - protein, 450 aa, Artificial Sequence
  Description of Artificial Sequence: Synthetic polypeptide
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205173 - protein, 213 aa, Artificial Sequence
  Description of Artificial Sequence: Synthetic polypeptide
DIQMTQSPSTLSASVGDRVTITCSASSRVGYMHWYQQKPGKAPKLLIYDTSKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205174 - protein, 495 aa, Artificial Sequence
  Description of Artificial Sequence: Synthetic polypeptide
AGASRPPHLVFLLADDLGWNDVGFHGSRIRTPHLDALAAGGVLLDNYYTQPLCTPSRSQLLTGRYQIRTGLQHQIIWPCQPSCVPLDEKLLPQLLKEAGYTTHMVGKWHLGMYRKECLPTRRGFDTYFGYLLGSEDYYSHERCTLIDALNVTRCALDFRDGEEVATGYKNMYSTNIFTKRAIALITNHPPEKPLFLYLALQSVHEPLQVPEEYLKPYDFIQDKNRHHYAGMVSLMDEAVGNVTAALKSSGLWNNTVFIFSTDNGGQTLAGGNNWPLRGRKWSLWEGGVRGVGFVASPLLKQKGVKNRELIHISDWLPTLVKLARGHTNGTKPLDGFDVWKTISEGSPSPRIELLHNIDPNFVDSSPCPRNSMAPAKDDSSLPEYSAFNTSVHAAIRHGNWKLLTGYPGCGYWFPPPSQYNVSEIPSSDPPTKTLWLFDIDRDPEERHDLSREYPHIVTKLLSRLQFYHKHSVPVYFPAQDPRCDPKATGVWGPWM

SEQ ID NO: 205175 - protein, 449 aa, Artificial Sequence
  Description of Artificial Sequence: Synthetic polypeptide
QVQLVQSGAEVKKPGASVKVSCKAFGYPFTDYLLHWVRQAPGQGLEWVGWLNPYSGDTNYAQKFQGRVTMTRDTSISTAYMELSRLRSDDTAVYYCTRTTLISVYFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205176 - protein, 214 aa, Artificial Sequence
  Description of Artificial Sequence: Synthetic polypeptide
DIQMTQSPSSVSASVGDRVTIACRASQNIRNILNWYQQRPGKAPQLLIYAASNLQSGVPSRFSGSGSGTDFTLTINSLQPEDFATYYCQQSYSMPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205177 - protein, 452 aa, Artificial Sequence
  Description of Artificial Sequence: Synthetic polypeptide
EVQLVESGGGLVQPGGSLRLSCAASGFTFSSYLMTWVRQAPGKGLEWVANIKQDGSEKYYVDSVKGRFTISRDNAKNSLNLQMNSLRAEDTAVYYCTRDGYSSGRHYGMDVWGQGTTVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205178 - protein, 214 aa, Artificial Sequence
  Description of Artificial Sequence: Synthetic polypeptide
EIVLTQSPATLSLSPGERATLSCRASQSVSRYLAWYQQKPGQAPRLLIYDASNRATGIPARFSGSGSGTDFTLTISSLEPEDFAVYYCQQRSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205179 - protein, 134 aa, Artificial Sequence; identical to SEQ ID NO: 55364
  Description of Artificial Sequence: Synthetic polypeptide

SEQ ID NO: 205180 - protein, 451 aa, Artificial Sequence
  Description of Artificial Sequence: Synthetic polypeptide
QVQLQESGPGLVKPSQTLSLTCTVSGGSISSGDYYWSWIRQPPGKGLEWIGYIYYSGSTDYNPSLKSRVTMSVDTSKNQFSLKVNSVTAADTAVYYCARVSIFGVGTFDYWGQGTLVTVSSASTKGPSVLPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205181 - protein, 214 aa, Artificial Sequence
  Description of Artificial Sequence: Synthetic polypeptide
EIVMTQSPATLSLSPGERATLSCRASQSVSSYLAWYQQKPGQAPRLLIYDASNRATGIPARFSGSGSGTDFTLTISSLEPEDFAVYYCHQYGSTPLTFGGGTKAEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205182 - protein, 440 aa, Artificial Sequence
  Description of Artificial Sequence: Synthetic polypeptide
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205183 - protein, 214 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205184 - protein, 449 aa, Artificial Sequence
  Description of Artificial Sequence: Synthetic polypeptide
QVQLQQSGPELKKPGASVKVSCKDSGYAFSSSWMNWVRQAPGQGLEWIGRIYPGDGDTNYNGKFQGRVTITADKSSSTAYMELSSLRSEDTAVYFCARSGLLRYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205185 - protein, 214 aa, Artificial Sequence
  Description of Artificial Sequence: Synthetic polypeptide
DIQMTQSPSSLSASVGDRVTITCRASQDIRNYLNWYQQKPGKAVKLLIYYTSRLLPGVPSRFSGSGSGTDYSLTISSQEQEDIGTYFCQQGNTLPWTFGQGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205186 - protein, 449 aa, Artificial Sequence
  Description of Artificial Sequence: Synthetic polypeptide
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205187 - protein, 219 aa, Artificial Sequence
  Description of Artificial Sequence: Synthetic polypeptide
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205188 - protein, 450 aa, Artificial Sequence
  Description of Artificial Sequence: Synthetic polypeptide
EVQLVQSGAEVKKPGESLKISCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKIKDTLMISRTPEVTCVVVDVSHEDPEVKFNWYVDGVEVHNAKTKPREEQYNSTYRVVSVLTVLHQDWLNGKEYKCKVSNKALPAPIEKTISKQKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205189 - protein, 213 aa, Artificial Sequence
  Description of Artificial Sequence: Synthetic polypeptide
EIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205190 - protein, 457 aa, Artificial Sequence
  Description of Artificial Sequence: Synthetic polypeptide
QLQLQESGPGLVKPSETLSLTCTVSGGSINSSSYYWGWLRQSPGKGLEWIGSFFYTGSTYYNPSLRSRLTISVDTSKNQFSLMLSSVTAADTAVYYCARQSTYYYGSGNYYGWFDRWDQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205191 - protein, 214 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPPAFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205192 - protein, 447 aa, Artificial Sequence
  Description of Artificial Sequence: Synthetic polypeptide
EVQLVESGGGLVQPGGSLRLSCAASGFNFNDYFMNWVRQAPGKGLEWVAQMRNKNYQYGTYYAESLEGRFTISRDDSKNSLYLQMNSLKTEDTAVYYCARESYYGFTSYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205193 - protein, 214 aa, Artificial Sequence
  Description of Artificial Sequence: Synthetic polypeptide
DIQMTQSPSSLSASVGDRVTITCQASQDIGISLSWYQQKPGKAPKLLIYNANNLADGVPSRFSGSGSGTDFTLTISSLQPEDFATYYCLQHNSAPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205194 - protein, 447 aa, Artificial Sequence
  Description of Artificial Sequence: Synthetic polypeptide
EVQLVESGGGLVQPGGSLRLSCAVSGYSITSGYSWNWIRQAPGKGLEWVASITYDGSTNYADSVKGRFTISRDDSKNTFYLQMNSLRAEDTAVYYCARGSHYFGHWHFAVWGQGTLVTVSSGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205195 - protein, 215 aa, Artificial Sequence
  Description of Artificial Sequence: Synthetic polypeptide
DIQLTQSPSSLSASVGDRVTITCRASQSVDYDGDSYMNWYQQKPGKAPKLLIYAASYLESGVPSRFSGSGSGTDFTLTISSLQPEDFATYYCQQSHEDPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNR

SEQ ID NO: 205196 - protein, 449 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 205197 - protein, 227 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205198 - protein, 220 aa, Artificial Sequence
  Description of Artificial Sequence: Synthetic polypeptide
DIQMTQSPSSLSASVGDRVTITCKSSQSLLYTSSQKNYLAWYQQKPGKAPKLLIYWASTRESGVPSRFSGSGSGTDFTLTISSLQPEDFATYYCQQYYAYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205199 - protein, 447 aa, Artificial Sequence
  Description of Artificial Sequence: Synthetic polypeptide
EVQLLESGGGLVQPGGSLRLSCAASGFTFSAYEMKWVRQAPGKGLEWVSVIGPSGGFTFYADSVKGRFTISRDNSKNTLYLQMNSLRAEDTAVYYCATEGDNDAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSAYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205200 - protein, 215 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLTISSLEPEDFAVYYCQQRSNWPMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205201 - protein, 647 aa, Artificial Sequence
  Description of Artificial Sequence: Synthetic polypeptide
HHHHHHDIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVELKRATPSHNSHQVPSAGGPTANSGTSGSEVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSEFGGAPEFPKPSTPPGSSGLEGGSLAALTAHQACHLPLETFTRHRQPRGWEQLEQCGYPVQRLVALYLAARLSWNQVDQVIRNALASPGSGGDLGEAIREQPEQARLALTLAAAESERFVRQGTGNDEAGAASADVVSLTCPVAAGECAGPADSGDALLERNYPTGAEFLGDGGDVSFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTGLTLAAPEAAGEVERLIGHPLPLRLDAITGPEEEGGRLETILGWPLAERTVVIPSAIPTDPRNVGGDLDPSSIPDKEQAISALPDYASQPGKPPHHHHHHKDEL

SEQ ID NO: 205202 - protein, 451 aa, Artificial Sequence
  Description of Artificial Sequence: Synthetic polypeptide
EVQLLESGGGLVQPGGSLRLSCAASGFTFSNAWMSWVRQAPGKGLEWVSSISVGGHRTYYADSVKGRSTISRDNSKNTLYLQMNSLRAEDTAVYYCARIRVGPSGGAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205203 - protein, 216 aa, Artificial Sequence
  Description of Artificial Sequence: Synthetic polypeptide
QSVLTQPPSASGTPGQRVTISCSGSNTNIGKNYVSWYQQLPGTAPKLLIYANSNRPSGVPDRFSGSKSGTSASLAISGLRSEDEADYYCASWDASLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 205204 - protein, 449 aa, Artificial Sequence
  Description of Artificial Sequence: Synthetic polypeptide
EVQLLESGGGLVQPGGSLRLSCAASGFTFSSFPMAWVRQAPGKGLEWVSTISTSGGRTYYRDSVKGRFTISRDNSKNTLYLQMNSLRAEDTAVYYCAKFRQYSGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205205 - protein, 216 aa, Artificial Sequence
  Description of Artificial Sequence: Synthetic polypeptide
DIQLTQPNSVSTSLGSTVKLSCTLSSGNIENNYVHWYQLYEGRSPTTMIYDDDKRPDGVPDRFSGSIDRSSNSAFLTIHNVAIEDEAIYFCHSYVSSFNVFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 205206 - protein, 483 aa, Artificial Sequence
  Description of Artificial Sequence: Synthetic polypeptide
EVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSGGGGSGGGGSGGGGSGGGGSGGGGSEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205207 - protein, 363 aa, Artificial Sequence
  Description of Artificial Sequence: Synthetic polypeptide
EVQLVESGGGLVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVTVSS

SEQ ID NO: 205208 - protein, 569 aa, Artificial Sequence
  Description of Artificial Sequence: Synthetic polypeptide
EEQVVESGGGFVQPGGSLRLSCAASGFTFSPYWMHWVRQAPGKGLVWVSRINSDGSTYYADSVKGRFTISRDNARNTLYLQMNSLRAEDTAVYYCARDRYYGPEMWGQGTMVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 205209 - protein, 138 aa, Artificial Sequence
  Description of Artificial Sequence: Synthetic polypeptide
GDDEATILADNKCMCTRVTSRIIPSTEDPNEDIVERNIRIVVPLNNRENISDPTSPLRRNFVYHLSDVCKKCDPVEVELEDQVVTATQSNICNEDDGVPETCYMYDRNKCYTTMVPLRYHGETKMVQAALTPDSCYPD

SEQ ID NO: 205210 - protein, 219 aa, Artificial Sequence
  Description of Artificial Sequence: Synthetic polypeptide
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205211 - protein, 115 aa, Artificial Sequence; identical to SEQ ID NO: 61271
  Description of Artificial Sequence: Synthetic polypeptide

SEQ ID NO: 205212 - protein, 453 aa, Artificial Sequence
  Description of Artificial Sequence: Synthetic polypeptide
EVQLVESGGGLVQPGGSLRLSCAASGYTFIDYYMNWVRQAPGKGLEWVGDINLDNSGTHYNQKFKGRFTISRDKSKNTAYLQMNSLRAEDTAVYYCAREGVYHDYDDYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205213 - protein, 219 aa, Artificial Sequence
  Description of Artificial Sequence: Synthetic polypeptide
DIQMTQSPSSLSASVGDRVTITCRTSQSLVHINAITYLHWYQQKPGKAPKLLIYRVSNRFSGVPSRFSGSGSGTDFTLTISSLQPEDFATYYCGQSTHVPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205214 - protein, 447 aa, Artificial Sequence
  Description of Artificial Sequence: Synthetic polypeptide
EVQLVESGGGLVQPGGSLRLSCAASGYTFTSYVIHWVRQAPGKGLEWVGYNNPYNAGTNYNEKFKGRFTISSDKSKNTAYLQMNSLRAEDTAVYYCSRPTMLPWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205215 - protein, 214 aa, Artificial Sequence
  Description of Artificial Sequence: Synthetic polypeptide
DIQMTQSPSSLSASVGDRVTITCRASQAVSSAVAWYQQKPGKAPKLLIYSASHRYTGVPSRFSGSGSGTDFTLTISSLQPEDFATYYCQESYSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205216 - protein, 447 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205217 - protein, 220 aa, Artificial Sequence
  Description of Artificial Sequence: Synthetic polypeptide
DIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205218 - protein, 408 aa, Artificial Sequence
  Description of Artificial Sequence: Synthetic polypeptide
SVFDSKFNGIHVYSEIGELETVLVHEPGREIDYITPARLDELLFSAILESHDARKEHQSFVKIMKDRGINVVELTDLVAETYDLASKAAKEEFIETFLEETVPVLTEANKEAVRAFLLSKPTHEMVEFMMSGITKYELGVESENELIVDPMPNLYFTRDPFASVGNGVTIHFMRYIVRRRETLFARFVFRNHPKLVKTPWYYDPAMKMSIEGGDVFIYNNETLVVGVSERTDLDTITLLAKNIKANKEVEFKRIVAINVPKWTNLMHLDTWLTMLDKNKFLYSPIANDVFKFWDYDLVNGGAEPQPQLNGLPLDKLLASIINKEPVLIPIGGAGATEMEIARETNFDGTNYLAIKPGLVIGYDRNEKTNAALKAAGITVLPFHGNQLSLGMGNARCMSMPLSRKDVKW

SEQ ID NO: 205219 - protein, 298 aa, Artificial Sequence
  Description of Artificial Sequence: Synthetic polypeptide
TYKKNDEVEFVRTGYGKDMIKVLHIQRDGKYHSIKEVATTVQLTLSSKKDYLHGDNSDVIPTDTIKNTVNVLAKFKGIKSIETFAVTICEHFLSSFKHVIRAQVYVEEVPWKRFEKNGVKHVHAFIYTPTGTHFCEVEQIRNGPPVIHSGIKDLKVLKTTQSGFEGFIKDQFTTLPEVKDRCFATQVYCKWRYHQGRDVDFEATWDTVRSIVLQKFAGPYDKGEYSPSVQKTLYDIQVLTLGQVPEIEDMEISLPNIHYLNIDMSKMGLINKEEVLLPLDNPYGKITGTVKRKLSSRL

SEQ ID NO: 205220 - protein, 106 aa, Artificial Sequence
  Description of Artificial Sequence: Synthetic polypeptide
MDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFN

SEQ ID NO: 205221 - protein, 447 aa, Artificial Sequence
  Description of Artificial Sequence: Synthetic polypeptide
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205222 - protein, 218 aa, Artificial Sequence
  Description of Artificial Sequence: Synthetic polypeptide
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205223 - protein, 452 aa, Artificial Sequence
  Description of Artificial Sequence: Synthetic polypeptide
EVQLVESGGGLVQPGGSLRLSCAASGFTFSDYTMLWVRQAPGKGLEWVAIIKSGGSYSYYPDSVKGRFTISRDNAKNSLYLQMNSLRAEDTAVYYCARDGDYGSSYGAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205224 - protein, 215 aa, Artificial Sequence
  Description of Artificial Sequence: Synthetic polypeptide
DIQMTQSPSSLSASVGDRVTITCRASQDINSYLSWFQQKPGKAPKSLIVRANRLVDGVPSRFSGSGSGQDYSLTISSLQPEDFATYYCLQYDAFPPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205225 - protein, 450 aa, Artificial Sequence
  Description of Artificial Sequence: Synthetic polypeptide
EVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205226 - protein, 219 aa, Artificial Sequence
  Description of Artificial Sequence: Synthetic polypeptide
DIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205227 - protein, 341 aa, Artificial Sequence
  Description of Artificial Sequence: Synthetic polypeptide
DIQMTQSPSSLSASVGDRVTITCRASQAIDSYLHWYQQKPGKAPKLLIYSASNLETGVPSRFSGSGSGTDFTLTISSLLPEDFATYYCQQVVWRPFTFGQGTKVEIKRVEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205228 - protein, 241 aa, Artificial Sequence; identical to SEQ ID NO: 63984
  Description of Artificial Sequence: Synthetic polypeptide

SEQ ID NO: 205229 - protein, 447 aa, Artificial Sequence
  Description of Artificial Sequence: Synthetic polypeptide
EVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205230 - protein, 218 aa, Artificial Sequence
  Description of Artificial Sequence: Synthetic polypeptide
DIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205231 - protein, 442 aa, Artificial Sequence
  Description of Artificial Sequence: Synthetic polypeptide
QVQLVQSGAEVKKPGASVKVSCKASGYYTEAYYIHWVRQAPGQGLEWMGRIDPATGNTKYAPRLQDRVTMTRDTSTSTVYMELSSLRSEDTAVYYCASLYSLPVYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 205232 - protein, 219 aa, Artificial Sequence
  Description of Artificial Sequence: Synthetic polypeptide
DVVMTQSPLSLPVTLGQPASISCKSSQSLLYSDAKTYLNWFQQRPGQSPRRLIYQISRLDPGVPDRFSGSGSGTDFTLKISRVEAEDVGVYYCLQGTHYPVLFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205233 - protein, 37 aa, Artificial Sequence
  Description of Artificial Sequence: Synthetic polypeptide
YTNSGVNTPPLIPGFNNSSHVLFNALRQTACTATNCK

SEQ ID NO: 205234 - protein, 92 aa, Artificial Sequence; identical to SEQ ID NO: 36079
  Description of Artificial Sequence: Synthetic polypeptide

SEQ ID NO: 205235 - protein, 92 aa, Artificial Sequence; identical to SEQ ID NO: 36079
  Description of Artificial Sequence: Synthetic polypeptide

SEQ ID NO: 205236 - protein, 92 aa, Artificial Sequence; identical to SEQ ID NO: 36079
  Description of Artificial Sequence: Synthetic polypeptide

SEQ ID NO: 205237 - protein, 447 aa, Artificial Sequence
  Description of Artificial Sequence: Synthetic polypeptide
EVQLVESGGGLVQPGGSLRLSCAASGFTFSDYGIAWVRQAPGKGLEWVAFISDLAYTIYYADTVTGRFTISRDNSKNTLYLQMNSLRAEDTAVYYCARDNWDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205238 - protein, 219 aa, Artificial Sequence
  Description of Artificial Sequence: Synthetic polypeptide
DIQMTQSPSSLSASVGDRVTITCRSSQSLVHNNANTYLHWYQQKPGKAPKLLIYKVSNRFSGVPSRFSGSGSGTDFTLTISSLQPEDFATYYCSQNTLVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205239 - protein, 357 aa, Artificial Sequence
  Description of Artificial Sequence: Synthetic polypeptide
EVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTVSSGDGSSGGSGGASEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIKSGGSGGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPESSRRGGC

SEQ ID NO: 205240 - protein, 456 aa, Artificial Sequence
  Description of Artificial Sequence: Synthetic polypeptide
EVQLVQSGAEVKKPGSSVKVSCKASGGTFNRYTVNWVRQAPGQGLEWMGGIIPIFGTANYAQRFQGRLTITADESTSTAYMELSSLRSDDTAVYFCARENLDNSGTYYYFSGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205241 - protein, 218 aa, Artificial Sequence
  Description of Artificial Sequence: Synthetic polypeptide
ESALTQPRSVSGSPGQSVTISCTGTSSDIGGYNFVSWYQQHPGKAPKLMIYDATKRPSGVPDRFSGSKSGNTASLTISGLQAEDEADYYCCSYAGDYTPGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 205242 - protein, 444 aa, Artificial Sequence
  Description of Artificial Sequence: Synthetic polypeptide
QVQLVQSGAEVKKPGASVKVSCKASGYTFTSYYMHWVRQAPGQGLEWMGEIHPSGGRTNYNEKFKSRVTMTRDTSTSTVYMELSSLRSEDTAVYYCARERPLYASDLWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 205243 - protein, 214 aa, Artificial Sequence
  Description of Artificial Sequence: Synthetic polypeptide
DIQMTQSPSSLSASVGDRVTITCKASQDVHTAVAWYQQKPGKAPKLLIYHASYRYTGVPSRFSGSGSGTDFTFTISSLQPEDIATYYCQQRYSLWRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205244 - protein, 446 aa, Artificial Sequence
  Description of Artificial Sequence: Synthetic polypeptide
EVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205245 - protein, 214 aa, Artificial Sequence
  Description of Artificial Sequence: Synthetic polypeptide
DIQMTQSPSSVSASIGDRVTITCRASQGIDNWLGWYQQKPGKAPKLLIYDASNLDTGVPSRFSGSGSGTYFTLTISSLQAEDFAVYFCQQAKAFPPTFGGGTKVDIKGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205246 - protein, 213 aa, Artificial Sequence
  Description of Artificial Sequence: Synthetic polypeptide
DIQLTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 205247 - protein, 218 aa, Artificial Sequence
  Description of Artificial Sequence: Synthetic polypeptide
EVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSGTAALGCLVKDYFPEPVTVSWNSGALTSGVHTFPAVLQSSGLYSLSSVVTVPSSSLGTQTYICNVNHKPSNTKVDKKVEPK

SEQ ID NO: 205248 - protein, 456 aa, Artificial Sequence
  Description of Artificial Sequence: Synthetic polypeptide
QVQLVQSGSELKKPGASVKVSCKASGYTFTNYGMNWVRQAPGQGLEWMGWINTYTGEPTYADDFTGRFVFSLDTSVSTAYLQISSLKAEDTAVYYCARNPINYYGINYEGYVMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205249 - protein, 219 aa, Artificial Sequence
  Description of Artificial Sequence: Synthetic polypeptide
DIVMTQSPDSLAVSLGERATINCKSSHSVLYSSNQKNYLAWYQQKPGQPPKLLIYWASTRESGVPDRFSGSGSGTDFTLTISSLQAEDVAVYYCHQYLSSLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205250 - protein, 880 aa, Artificial Sequence
  Description of Artificial Sequence: Synthetic polypeptide
SERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKVPAPRYTVEKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205251 - protein, 446 aa, Artificial Sequence
  Description of Artificial Sequence: Synthetic polypeptide
QVQLQESGPGLVKPSETLSLTCTVSGGSISIYYWSWIRQPPGKGLEWIGYVYYSGSTNYNPSLKSRVTISVDTSKNQFSLKLNSVTAADTAVYYCARGGYDFWSGYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 205252 - protein, 215 aa, Artificial Sequence
  Description of Artificial Sequence: Synthetic polypeptide
EIVMTQSPATLSVSPGERATLSCRASQSVDSNLAWYRQKPGQAPRLLIYGASTRATGIPARFSGSGSGTEFTLTISSLQSEDFAVYYCQQYINWPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205253 - protein, 448 aa, Artificial Sequence
  Description of Artificial Sequence: Synthetic polypeptide
QLQLQESGPGLVKPSETLSLTCTVSGGSITSSSYYWGWIRQPPGKGLEWIGSIYYRGSTNYNPSLKSRVTISVDSSKNQFYLKVSSVTAVDTAVYYCARQNGAARPSWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 205254 - protein, 215 aa, Artificial Sequence
  Description of Artificial Sequence: Synthetic polypeptide
EIVLTQSPDTISLSPGERATLSCRASQSISSIYLAWYQQKPGQAPRLLIYGASSRVTGIPDRFSVSGSGTDFTLTISRLEPEDFAVYYCQHYGISPFTFGPGTKVDIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205255 - protein, 451 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205256 - protein, 213 aa, Artificial Sequence
  Description of Artificial Sequence: Synthetic polypeptide
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205257 - protein, 448 aa, Artificial Sequence
  Description of Artificial Sequence: Synthetic polypeptide
EVQLVQSGGGLVKPGGSLRLSCAASGFTFSSFAMHWVRQAPGKGLEWISVIDTRGATYYADSVKGRFTISRDNAKNSLYLQMNSLRAEDTAVYYCARLGNFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205258 - protein, 214 aa, Artificial Sequence
  Description of Artificial Sequence: Synthetic polypeptide
EIVLTQSPGTLSVSPGERATLSCRASQSIGSSLHWYQQKPGQAPRLLIKYASQSLSGIPDRFSGSGSGTDFTLTISRLEPEDFAVYYCHQSSRLPHTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205259 - protein, 456 aa, Artificial Sequence
  Description of Artificial Sequence: Synthetic polypeptide
QVQLVESGGGVVQPGRSLRLSCTASGFTFKNYAMHWVRQAPAKGLEWVATISYDGRNIQYADSVKGRFTFSRDNSQDTLYLQLNSLRPEDTAVYYCARPVRSRWLQLGLEDAFHIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205260 - protein, 214 aa, Artificial Sequence
  Description of Artificial Sequence: Synthetic polypeptide
AIRMTQSPSSFSASTGDRVTITCRASQDIRNYVAWYQQKSGKAPKFLIYAASTLQSGVPSRFSGSGSGTDFTLTINSLQSEDFATYYCQQYYNSPPTFGQGTRVEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205261 - protein, 269 aa, Artificial Sequence [sequence omitted]

SEQ ID NO: 205262 - protein, 449 aa, Artificial Sequence
  Description of Artificial Sequence: Synthetic polypeptide
EVQLVQSGAEVKKPGASVKVSCKASGYTFTDYNMHWVRQAPGQGLEWMGEINPNSGGAGYNQKFKGRVTMTTDTSTSTAYMELRSLRSDDTAVYYCARLGYDDIYDDWYFDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 205263 - protein, 214 aa, Artificial Sequence
  Description of Artificial Sequence: Synthetic polypeptide
DIQMTQSPSSLSASVGDRVTITCRASQDISNYLNWYQQKPGKAPKLLIYYTSRLLSGVPSRFSGSGSGTDFTLTISSLQPEDFATYYCQQGDTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205264 - protein, 447 aa, Artificial Sequence
  Description of Artificial Sequence: Synthetic polypeptide
EVQLVESGGGLVQPGGSLRLSCATSGYTFTEYIIHWVRQAPGKGLEWVASINPDYDITNYNQRFKGRFTISLDKSKRTAYLQMNSLRAEDTAVYYCASWISDFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205265 - protein, 218 aa, Artificial Sequence
  Description of Artificial Sequence: Synthetic polypeptide
DIQMTQSPSSLSASVGDRVTITCRASQSVSTSSYSYMHWYQQKPGKAPKVLISYASNLESGVPSRFSGSGSGTDFTLTISSLQPEDFATYYCQHSWGIPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205266 - protein, 451 aa, Artificial Sequence
  Description of Artificial Sequence: Synthetic polypeptide
QVQLQQSGSELKKPGASVKVSCKASGYTFTNYGMNWVKQAPGQGLKWMGWINTYTGEPTYTDDFKGRFAFSLDTSVSTAYLQISSLKADDTAVYFCARGGFGSSYWYFDVWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205267 - protein, 214 aa, Artificial Sequence
  Description of Artificial Sequence: Synthetic polypeptide
DIQLTQSPSSLSASVGDRVSITCKASQDVSIAVAWYQQKPGKAPKLLIYSASYRYTGVPDRFSGSGSGTDFTLTISSLQPEDFAVYYCQQHYITPLTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205268 - protein, 442 aa, Artificial Sequence
  Description of Artificial Sequence: Synthetic polypeptide
QVQLQQSGSELKKPGASVKISCKASGYSFTDYIILWVRQNPGKGLEWIGHIDPYYGSSNYNLKFKGRVTITADQSTTTAYMELSSLRSEDTAVYYCGRSKRDYFDYWGQGTTLTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 205269 - protein, 214 aa, Artificial Sequence
  Description of Artificial Sequence: Synthetic polypeptide
DIQMTQSPSSLSASIGDRVTITCKASQDINSYLSWFQQKPGKAPKLLIYRANRLVDGVPSRFSGSGSGTDYTLTISSLQPEDFAVYYCLQYDEFPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205270 - protein, 446 aa, Artificial Sequence
  Description of Artificial Sequence: Synthetic polypeptide
EVQLVESGGGLVQPGRSLRLSCAASRFTFDDYAMHWVRQAPGKGLEWVSGISWNSGRIGYADSVKGRFTISRDNAENSLFLQMNGLRAEDTALYYCAKGRDSFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205271 - protein, 214 aa, Artificial Sequence
  Description of Artificial Sequence: Synthetic polypeptide
DIQMTQSPSSVSASVGDRVTITCRASQGISSWLAWYQQKPGKAPKLLIYGASSLESGVPSRFSGSGSGTDFTLTISSLQPEDFASYYCQQANSFPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205272 - protein, 378 aa, Artificial Sequence
  Description of Artificial Sequence: Synthetic polypeptide
SGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 205273 - protein, 121 aa, Artificial Sequence; identical to SEQ ID NO: 77001
  Description of Artificial Sequence: Synthetic polypeptide

SEQ ID NO: 205274 - protein, 457 aa, Artificial Sequence
  Description of Artificial Sequence: Synthetic polypeptide
EVQLVESGGGLVQPGGSLRLSCAASGFTFSNYWMNWVRQAPGKGLEWVAAINQDGSEKYYVGSVKGRFTISRDNAKNSLYLQMNSLRVEDTAVYYCVRDYYDILTDYYIHYWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205275 - protein, 215 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPCTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205276 - protein, 454 aa, Artificial Sequence
  Description of Artificial Sequence: Synthetic polypeptide
FGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 205277 - protein, 449 aa, Artificial Sequence
  Description of Artificial Sequence: Synthetic polypeptide
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDK

SEQ ID NO: 205278 - protein, 445 aa, Artificial Sequence
  Description of Artificial Sequence: Synthetic polypeptide
EVQLLESGGGLVQPGGSLRLSCAASGFTFSHYVMAWVRQAPGKGLEWVSSISSSGGWTLYADSVKGRFTISRDNSKNTLYLQMNSLRAEDTAVYYCTRGLKMATIFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 205279 - protein, 217 aa, Artificial Sequence
  Description of Artificial Sequence: Synthetic polypeptide
QSALTQPASVSGSPGQSITISCTGTSSDVGSYNVVSWYQQHPGKAPKLIIYEVSQRPSGVSNRFSGSKSGNTASLTISGLQTEDEADYYCCSYAGSSIFVIFGGGTKVTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 205280 - protein, 609 aa, Artificial Sequence [sequence omitted]

SEQ ID NO: 205281 - protein, 609 aa, Artificial Sequence [sequence omitted]

SEQ ID NO: 205282 - protein, 609 aa, Artificial Sequence [sequence omitted]

SEQ ID NO: 205283 - protein, 609 aa, Artificial Sequence [sequence omitted]

SEQ ID NO: 205284 - protein, 609 aa, Artificial Sequence [sequence omitted]

SEQ ID NO: 205285 - protein, 609 aa, Artificial Sequence [sequence omitted]

SEQ ID NO: 205286 - protein, 609 aa, Artificial Sequence [sequence omitted]

SEQ ID NO: 205287 - protein, 609 aa, Artificial Sequence [sequence omitted]

SEQ ID NO: 205288 - protein, 446 aa, Artificial Sequence
  Description of Artificial Sequence: Synthetic polypeptide
QVQLVQSGAEVKKPGASVKVSCKASGYTFTSYSISWVRQAPGQGLEWMGWISVYNGNTNYAQKFQGRVTMTTDTSTSTAYLELRSLRSDDTAVYYCARDPIAAGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205289 - protein, 215 aa, Artificial Sequence
  Description of Artificial Sequence: Synthetic polypeptide
EIVLTQSPGTLSLSPGERATLSCRASQSVSSTYLAWYQQKPGQAPRLLIYGASSRATGIPDRFSGSGSGTDFTLTISRLEPEDFAVYYCQQYGSSPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205290 - protein, 449 aa, Artificial Sequence
  Description of Artificial Sequence: Synthetic polypeptide
EVQLVESGGKLLKPGGSLKLSCAASGFTFSSFAMSWFRQSPEKRLEWVAEISSGGSYTYYPDTVTGRFTISRDNAKNTLYLEMSSLRSEDTAMYYCARGLWGYYALDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205291 - protein, 213 aa, Artificial Sequence
  Description of Artificial Sequence: Synthetic polypeptide
QIVLIQSPAIMSASPGEKVTMTCSASSSVSYMYWYQQKPGSSPRLLIYDTSNLASGVPVRFSGSGSGTSYSLTISRMEAEDAATYYCQQWSGYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205292 - protein, 443 aa, Artificial Sequence
  Description of Artificial Sequence: Synthetic polypeptide
QVQLVQSGAEVKKPGASVKVSCKASGYAFTYYLIEWVRQAPGQGLEWIGVINPGSGGTNYNEKFKGRATITADKSTSTAYMELSSLRSEDTAVYFCARNWMNFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205293 - protein, 219 aa, Artificial Sequence
  Description of Artificial Sequence: Synthetic polypeptide
DIVMTQTPLSLSVTPGQPASISCRSSKSLLHSNGNTYLYWFLQKPGQSPQFLIYRMSNLASGVPDRFSGSGSGTDFTLKISRVEAEDVGVYYCMQHLEYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205294 - protein, 449 aa, Artificial Sequence
  Description of Artificial Sequence: Synthetic polypeptide
EVQLVESGGGLVQPGGSLRLSCAASGFTFSPFAMSWVRQAPGKGLEWVAKISPGGSWTYYSDTVTGRFTISRDNAKNSLYLQMNSLRAEDTAVYYCARQLWGYYALDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205295 - protein, 213 aa, Artificial Sequence
  Description of Artificial Sequence: Synthetic polypeptide
EIVLTQSPATLSLSPGERATLSCSASISVSYMYWYQQKPGQAPRLLIYDMSNLASGIPARFSGSGSGTDFTLTISSLEPEDFAVYYCMQWSGYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205296 - protein, 446 aa, Artificial Sequence
  Description of Artificial Sequence: Synthetic polypeptide
EVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205297 - protein, 214 aa, Artificial Sequence
  Description of Artificial Sequence: Synthetic polypeptide
DIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205298 - protein, 442 aa, Artificial Sequence
  Description of Artificial Sequence: Synthetic polypeptide
EVQLVESGGGLVQPGGSLRLSCAASGFTFSRYSMSWVRQAPGKGLELVAQINSVGNSTYYPDTVKGRFTISRDNAKNTLYLQMNSLRAEDTAVYYCASGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205299 - protein, 219 aa, Artificial Sequence
  Description of Artificial Sequence: Synthetic polypeptide
DVVMTQSPLSLPVTLGQPASISCRSSQSLIYSDGNAYLHWFLQKPGQSPRLLIYKVSNRFSGVPDRFSGSGSGTDFTLKISRVEAEDVGVYYCSQSTHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205300 - protein, 108 aa, Artificial Sequence; identical to SEQ ID NO: 36523
  Description of Artificial Sequence: Synthetic polypeptide

SEQ ID NO: 205301 - protein, 217 aa, Artificial Sequence; identical to SEQ ID NO: 36496
  Description of Artificial Sequence: Synthetic polypeptide

SEQ ID NO: 205302 - protein, 217 aa, Artificial Sequence; identical to SEQ ID NO: 36496
  Description of Artificial Sequence: Synthetic polypeptide

SEQ ID NO: 205303 - protein, 217 aa, Artificial Sequence; identical to SEQ ID NO: 36496
  Description of Artificial Sequence: Synthetic polypeptide

SEQ ID NO: 205304 - protein, 344 aa, Artificial Sequence
  Description of Artificial Sequence: Synthetic polypeptide
ILGRSETQECLFFNANWEKDRTNQTGVEPCYGDKDKRRHCFATWKNISGSIEIVKQGCWLDDINCYDRTDCVEKKDSPEVYFCCCEGNMCNEKFSYFPEMEVTQPTSNPVTPKPPTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPVPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205305 - protein, 448 aa, Artificial Sequence
  Description of Artificial Sequence: Synthetic polypeptide
QVQLVQSGAEVKKPGASVKVSCKASGYTFTNSWIGWFRQAPGQGLEWIGDIYPGGGYTNYNEIFKGKATMTADTSTNTAYMELSSLRSEDTAVYYCSRGIPGYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205306 - protein, 220 aa, Artificial Sequence
  Description of Artificial Sequence: Synthetic polypeptide
DIQMTQRPDSLSASVGDRVTMSCKSSQSLLNSGDQKNYLTWYQQKPGQPPKLLIYWASTGESGVPDRFSGSGSGTDFTFTISSLQPEDIATYYCQNDYSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205307 - protein, 450 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGYYDILTGYYYYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205308 - protein, 214 aa, Artificial Sequence
  Description of Artificial Sequence: Synthetic polypeptide
EIVLTQSPATLSLSPGERATLSCRASQSVSRYLAWYQQKPGQAPRLLIYDASNRATGIPARFSGSGSGTDSTLTISSLEPEDFAVYYCQQRSNWPRTFGQGTKVEIKRTVAAPSVFIFPPSDEQLKSGTASVVCLLNNFYPREAKVQWKVDNALQSGNSQESVTEQDSKDSTYSLSNTLTLSKADYEKHKVYACEVTHQGLSSPVTKSFNRGEC

SEQ ID NO: 205309 - protein, 226 aa, Artificial Sequence
  Description of Artificial Sequence: Synthetic polypeptide
QVQLVQSGAEVKKPGSSVKVSCKASGYAFTNYLIEWVRQAPGQGLEWIGVIYPGSGGTNYNEKFKGRVTLTVDESTNTAYMELSSLRSEDTAVYFCARRDGNYGWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 205310 - protein, 194 aa, Artificial Sequence
  Description of Artificial Sequence: Synthetic polypeptide
DIQMTQTPSTLSASVGDRVTISCRASQDINNYLNWYQQKPGKAPKLLIYYTSTLHSGVPSRFSGSGSGTDYTLTISSLQPDDFATYFCQQGNTLPWTFGQGTKVEVKRTVAAPSVFIFPPSDEQLKSGTASVVCLLNNFYESVTEQDSKDSTYSLSSTLTLSKADYEKHKVYACEVTHQGLSSPVTKSFNRGEC

SEQ ID NO: 205311 - protein, 441 aa, Artificial Sequence
  Description of Artificial Sequence: Synthetic polypeptide
EVQLVESGGGLVQPGGSLRLSCAASGFTFSSSGMSWVRQAPGKGLEWVSVIASSGSNTYYADSVKGRFTISRDNSKNTLYLQMNSLRAEDTAVYYCARSIFYTTWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 205312 - protein, 215 aa, Artificial Sequence
  Description of Artificial Sequence: Synthetic polypeptide
DIVLTQSPATLSLSPGERATLSCRASQSVRSNYLAWYQQKPGQAPRLLIYGASSRATGVPARFSGSGSGTDFTLTISSLEPEDFAVYYCQQYSNFPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205313 - protein, 27 aa, Artificial Sequence
  Description of Artificial Sequence: Synthetic peptide
STAPPAHGVTSAPDTRPAPGSTAPPKG

SEQ ID NO: 205314 - protein, 449 aa, Artificial Sequence
  Description of Artificial Sequence: Synthetic polypeptide
QVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205315 - protein, 213 aa, Artificial Sequence
  Description of Artificial Sequence: Synthetic polypeptide
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205316 - protein, 448 aa, Artificial Sequence
  Description of Artificial Sequence: Synthetic polypeptide
QVELVESGGGVVQPGRSQRLSCAASGFTFSSYGMHWVRQAPGKGLEWVAIIWFDGSSTYYADSVRGRFTISRDNSKNTLYLQMNSLRAEDTAVYFCARELGRRYFDLWGRGTLVSVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205317 - protein, 215 aa, Artificial Sequence
  Description of Artificial Sequence: Synthetic polypeptide
EIVLTQSPATLSLSPGERATLSCRASQSVSSYLAWYQQKPGQAPRLLIYDASKRATGIPARFSGSGSGTDFTLTISSLEPEDFAVYYCQQRSKWPPWTFGQGTKVESKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205318 - protein, 498 aa, Artificial Sequence
  Description of Artificial Sequence: Synthetic polypeptide
APAEPQPGGSQCVEHDCFALYPGPATFLNASQICDGLRGHLMTVRSSVAADVISLLLNGDGGVGRRRLWIGLQLPPGCGDPKRLGPLRGFQWVTGDNNTSYSRWARLDLNGAPLCGPLCVAVSAAEATVPSEPIWEEQQCEVKADGFLCEFHFPATCRPLAVEPGAAAAAVSITYGTPFAARGADFQALPVGSSAAVAPLGLQLMCTAPPGAVQGHWAREAPGAWDCSVENGGCEHACNAIPGAPRCQCPAGAALQADGRSCTASATQSCNDLCEHFCVPNPDQPGSYSCMCETGYRLAADQHRCEDVDDCILEPSPCPQRCVNTQGGFECHCYPNYDLVDGECVEPVDPCFRANCEYQCQPLNQTSYLCVCAEGFAPIPHEPHRCQMFCNQTACPADCDPNTQASCECPEGYILDDGFICTDIDECENGGFCSGVCHNLPGTFECICGPDSALVRHIGTDCDSGKVDGGDSGSGEPPPSPTPGSTLTPPAVGLVHSG

SEQ ID NO: 205319 - protein, 138 aa, Artificial Sequence
  Description of Artificial Sequence: Synthetic polypeptide
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSV

SEQ ID NO: 205320 - protein, 138 aa, Artificial Sequence; identical to SEQ ID NO: 205319
  Description of Artificial Sequence: Synthetic polypeptide

SEQ ID NO: 205321 - protein, 449 aa, Artificial Sequence
  Description of Artificial Sequence: Synthetic polypeptide
EVQLVESGGGLVQPGGSLRLSCAASGFTFSSYVMSWVRQAPGKGLEWVATISSGGSYTYYPDSVKGRFTISRDNAKNTLYLQMNSLRAEDTAVYYCARRGDSMITTDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205322 - protein, 213 aa, Artificial Sequence
  Description of Artificial Sequence: Synthetic polypeptide
DIQMTQSPSSLSASVGDRVTITCKASQDVGTAVAWYQQKPGKAPKLLIYWASTRHTGVPSRFSGSGSGTDFTLTISSLQPEDFATYYCQQYSSYRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205323 - protein, 562 aa, Artificial Sequence; identical to SEQ ID NO: 63886
  Description of Artificial Sequence: Synthetic polypeptide

SEQ ID NO: 205324 - protein, 449 aa, Artificial Sequence
  Description of Artificial Sequence: Synthetic polypeptide
QVQLVQSGAEVKKPGASVKVSCKASGYTFTNYGLSWVRQAPGQGLEWMGWISANNGDTNYGQEFQGRVTMTTDTSTSTAYMELRSLRSDDTAVYYCARDSSSSWARWFFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205325 - protein, 214 aa, Artificial Sequence
  Description of Artificial Sequence: Synthetic polypeptide
SYVLTQPPSVSVAPGKTARITCGGNIIGSKLVHWYQQKPGQAPVLVIYDDGDRPSGIPERFSGSNSGNTATLTISRVEAGDEADYYCQVWDTGSDPVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 205326 - protein, 449 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205327 - protein, 214 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205328 - protein, 214 aa, Artificial Sequence; identical to SEQ ID NO: 205327
  Description of Artificial Sequence: Synthetic polypeptide

SEQ ID NO: 205329 - protein, 451 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205330 - protein, 454 aa, Artificial Sequence
  Description of Artificial Sequence: Synthetic polypeptide
EEQLVESGGGLVKPGGSLRLSCAASGFSFSDCRMYWLRQAPGKGLEWIGVISVKSENYGANYAESVRGRFTISRDDSKNTVYLQMNSLKTEDTAVYYCSASYYRYDVGAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205331 - protein, 218 aa, Artificial Sequence
  Description of Artificial Sequence: Synthetic polypeptide
DIVMTQSPDSLAVSLGERATINCRASKSVSTSGYSYIYWYQQKPGQPPKLLIYLASILESGVPDRFSGSGSGTDFTLTISSLQAEDVAVYYCQHSRELPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205332 - protein, 415 aa, Artificial Sequence
  Description of Artificial Sequence: Synthetic polypeptide
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 205333 - protein, 447 aa, Artificial Sequence
  Description of Artificial Sequence: Synthetic polypeptide
EVQVLESGGDLVQPGGSLRLSCAASGFTFSAYAMTWVRQAPGKGLEWVSAISGSGGSAYYADSVKGRFTISRDNSKNTVYLQMNSLRAEDTAVYYCAKDGAWKMSGLDVWGQGTTVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205334 - protein, 214 aa, Artificial Sequence
  Description of Artificial Sequence: Synthetic polypeptide
DIQMTQSPASLSASVGDRVTITCRASQDISDYLAWYQQKPGKIPRLLIYTTSTLQSGVPSRFRGSGSGTDFTLTISSLQPEDVATYYCQKYDSAPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205335 - protein, 465 aa, Artificial Sequence; identical to SEQ ID NO: 61109
  Description of Artificial Sequence: Synthetic polypeptide

SEQ ID NO: 205336 - protein, 461 aa, Artificial Sequence; identical to SEQ ID NO: 93882
  Description of Artificial Sequence: Synthetic polypeptide

SEQ ID NO: 205337 - protein, 467 aa, Artificial Sequence
  Description of Artificial Sequence: Synthetic polypeptide
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDEPKSCDKTHTCPPCPAPELLGGPSVFLFPPKPKDTLMISRTPEVTCVVVDVSHEDPQVKFNWYVDGVQVHNAKTKPREQQYNSTYRVVSVLTVLHQNWLDGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205338 - protein, 448 aa, Artificial Sequence
  Description of Artificial Sequence: Synthetic polypeptide
QAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205339 - protein, 213 aa, Artificial Sequence
  Description of Artificial Sequence: Synthetic polypeptide
QIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205340 - protein, 451 aa, Artificial Sequence
  Description of Artificial Sequence: Synthetic polypeptide
EVQLVESGGGLVQPGGSLRLSCAAAGFTFSSYSMNWVRQAPGKGLEWVSYISSRSRTIYYADSVKGRFTISRDNAKNSLYLQMNSLRDEDTAVYYCARDYGGQPPYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 205341 - protein, 214 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFVTYYCQQYNSYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205342 - protein, 448 aa, Artificial Sequence
  Description of Artificial Sequence: Synthetic polypeptide
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205343 - protein, 216 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFCGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205344 - protein, 431 aa, Artificial Sequence [sequence omitted]

SEQ ID NO: 205345 - protein, 463 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARSPNPYYYDSSGYYYPGAFDIWGQGTMVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 205346 - protein, 453 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205347 - protein, 213 aa, Artificial Sequence
  Description of Artificial Sequence: Synthetic polypeptide
QPGLTQPPSVSVAPGQTARITCGGNNIGSKSVHWYQQKPGQAPVLVVYDDSDRPSGIPERFSGSNSGNTATLTISRVEAGDEADYYCQVWDSSSDHYVFGTGTKVTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 205348 - protein, 214 aa, Artificial Sequence; identical to SEQ ID NO: 204941
  Description of Artificial Sequence: Synthetic polypeptide

SEQ ID NO: 205349 - protein, 452 aa, Artificial Sequence
  Description of Artificial Sequence: Synthetic polypeptide
QVQLVESGGGVVQPGRSLRLSCAASGFTFSSYDMHWVRQAPGKGLEWVAVIWYDGSNKYYADSVKGRFTISRDNSKNTLYLQMNSLRAEDTAVYYCARGSGNWGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGSS

SEQ ID NO: 205350 - protein, 214 aa, Artificial Sequence
  Description of Artificial Sequence: Synthetic polypeptide
DIQMTQSPSSLSASVGDRVTITCRASQGISRWLAWYQQKPEKAPKSLIYAASSLQSGVPSRFSGSGSGTDFTLTISSLQPEDFATYYCQQYNTYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205351 - protein, 164 aa, Artificial Sequence; identical to SEQ ID NO: 6180
  Description of Artificial Sequence: Synthetic polypeptide

SEQ ID NO: 205352 - protein, 446 aa, Artificial Sequence
  Description of Artificial Sequence: Synthetic polypeptide
QVQLQESGPGLVKPSETLSLTCTVSGFSLTNYGIHWIRQPPGKGLEWLGVIWARGFTNYNSALMSRLTISKDNSKNQVSLKLSSVTAADTAVYYCARANDGVYYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205353 - protein, 213 aa, Artificial Sequence
  Description of Artificial Sequence: Synthetic polypeptide
DFVMTQSPAFLSVTPGEKVTITCSAQSSVNYIHWYQQKPDQAPKKLIYDTSKLASGVPSRFSGSGSGTDYTFTISSLEAEDAATYYCQQWTTNPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205354 - protein, 451 aa, Artificial Sequence
  Description of Artificial Sequence: Synthetic polypeptide
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDGWDYAIDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205355 - protein, 219 aa, Artificial Sequence
  Description of Artificial Sequence: Synthetic polypeptide
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQGTHQPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205356 - protein, 451 aa, Artificial Sequence
  Description of Artificial Sequence: Synthetic polypeptide
QVQLQQSGAEVKKPGSSVKVSCKASGYTFTSYNMHWVKQAPGQGLEWIGAIYPGMGDTSYNQKFKGKATLTADESTNTAYMELSSLRSEDTAFYYCARSTYYGGDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205357 - protein, 213 aa, Artificial Sequence
  Description of Artificial Sequence: Synthetic polypeptide
DIQLTQSPSSLSASVGDRVTMTCRASSSVSYIHWFQQKPGKAPKPWIYATSNLASGVPVRFSGSGSGTDYTFTISSLQPEDIATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205358 - protein, 453 aa, Artificial Sequence
  Description of Artificial Sequence: Synthetic polypeptide
EVQLVESGGGLVQPGGSLRLSCAASGFTFSSYAMSWVRQAPGKGLEWVSQISPAGGYTNYADSVKGRFTISADTSKNTAYLQMNSLRAEDTAVYYCARGELPYYRMSKVMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205359 - protein, 214 aa, Artificial Sequence
  Description of Artificial Sequence: Synthetic polypeptide
DIQMTQSPSSLSASVGDRVTITCRASQYFSSYLAWYQQKPGKAPKLLIYGASSRASGVPSRFSGSGSGTDFTLTISSLQPEDFATYYCQQYLGSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205360 - protein, 240 aa, Artificial Sequence
  Description of Artificial Sequence: Synthetic polypeptide
VVGGTEAGRNSWPSQISLQYRSGGSWYHTCGGTLIRQNWVMTAAHCVDYQKTFRVVAGDHNLSQNDGTEQYVSVQKIVVHPYWNSDNVAAGYDIALLRLAQSVTLNSYVQLGVLPQEGAILANNSPCYITGWGKTKTNGQLAQTLQQAYLPSVDYAICSSSSYWGSTVKNTMVCAGGDGVRSGCQGDSGGPLHCLVNGKYSLHGVTSFVSSRGCNVSRKPTVFTRVSAYISWINNVIASN

SEQ ID NO: 205361 - protein, 448 aa, Artificial Sequence
  Description of Artificial Sequence: Synthetic polypeptide
QVQLVQSGAEVKKPGASVKVSCKASGYTFTNYGMNWVRQAPGQGLKWMGWINTYTGEPTYADAFKGRVTMTRDTSISTAYMELSRLRSDDTAVYYCARDYGDYGMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205362 - protein, 448 aa, Artificial Sequence; identical to SEQ ID NO: 205361
  Description of Artificial Sequence: Synthetic polypeptide

SEQ ID NO: 205363 - protein, 218 aa, Artificial Sequence
  Description of Artificial Sequence: Synthetic polypeptide
DIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205364 - protein, 218 aa, Artificial Sequence; identical to SEQ ID NO: 205363
  Description of Artificial Sequence: Synthetic polypeptide

SEQ ID NO: 205365 - protein, 448 aa, Artificial Sequence
  Description of Artificial Sequence: Synthetic polypeptide
QVQLQQPGAELVEPGGSVKLSCKASGYTFTSHWMHWVKQRPGQGLEWIGEINPSSGRNNYNEKFKSKATLTVDKSSSTAYMQFSSLTSEDSAVYYCVRYYGYDEAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205366 - protein, 219 aa, Artificial Sequence
  Description of Artificial Sequence: Synthetic polypeptide
DIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205367 - protein, 25 aa, Artificial Sequence
  Description of Artificial Sequence: Synthetic peptide
CKGKGAKCSRLMYDCCTGSCRSGKC

SEQ ID NO: 205368 - protein, 33 aa, Homo sapiens
MGLHLRPYRVGLLPDGLLFLLLLLMLLADPALP

SEQ ID NO: 205369 - protein, 24 aa, Homo sapiens
MSAPKLLSLGCIFFPLLLFQQARA

SEQ ID NO: 205370 - protein, 26 aa, Homo sapiens
MCPRAARAPATLLLALGAVLWPAAGA

SEQ ID NO: 205371 - protein, 18 aa, Homo sapiens
MKLSLVAAMLLLLSAARA

SEQ ID NO: 205372 - protein, 20 aa, Homo sapiens
MEPWPLLLLFSLCSAGLVLG

SEQ ID NO: 205373 - protein, 23 aa, Homo sapiens
MTPGALLMLLGALGAPLAPGVRG

SEQ ID NO: 205374 - protein, 20 aa, Homo sapiens
MARAPLGVLLLLGLLGRGVG

SEQ ID NO: 205375 - protein, 19 aa, Homo sapiens
MVEMLPTAILLVLAVSVVA

SEQ ID NO: 205376 - protein, 16 aa, Homo sapiens
MFRLWLLLAGLCGLLA

SEQ ID NO: 205377 - protein, 28 aa, Homo sapiens
MECCRRATPGTLLLFLAFLLLSSRTARS

SEQ ID NO: 205378 - protein, 18 aa, Homo sapiens
MLLLGAVLLLLALPGHDQ

SEQ ID NO: 205379 - protein, 21 aa, Homo sapiens
MKLVSVALMYLGSLAFLGADT

SEQ ID NO: 205380 - protein, 16 aa, Homo sapiens
MTTLLWVFVTLRVITA

SEQ ID NO: 205381 - protein, 17 aa, Homo sapiens
MISPFLVLAIGTCLTNS

SEQ ID NO: 205382 - protein, 18 aa, Homo sapiens
MALSWVLTVLSLLPLLEA

SEQ ID NO: 205383 - protein, 18 aa, Homo sapiens
MALSWVLTVLSLLPLLEA

SEQ ID NO: 205384 - protein, 23 aa, Homo sapiens
MERMLPLLALGLLAAGFCPAVLC

SEQ ID NO: 205385 - protein, 24 aa, Homo sapiens
MPSSVSWGILLLAGLCCLVPVSLA

SEQ ID NO: 205386 - protein, 21 aa, Homo sapiens
MSMLVVFLLLWGVTWGPVTEA

SEQ ID NO: 205387 - protein, 27 aa, Homo sapiens
MALLWGLLVLSWSCLQGPCSVFSPVSA

SEQ ID NO: 205388 - protein, 18 aa, Homo sapiens
MKSLVLLLCLAQLWGCHS

SEQ ID NO: 205389 - protein, 23 aa, Homo sapiens
MGKNKLLHPSLVLLLLVLLPTDA

SEQ ID NO: 205390 - protein, 15 aa, Homo sapiens
MKFFLLLFTIGFCWA

SEQ ID NO: 205391 - protein, 18 aa, Homo sapiens
MKWVESIFLIFLLNFTES

SEQ ID NO: 205392 - protein, 31 aa, Homo sapiens
MQLRNPELHLGCALALRFLALVSWDIPGARA

SEQ ID NO: 205393 - protein, 19 aa, Homo sapiens
MRFFVPLFLVGILFPAILA

SEQ ID NO: 205394 - protein, 17 aa, Homo sapiens
MLLKTVLLLGHVAQVLM

SEQ ID NO: 205395 - protein, 23 aa, Homo sapiens
MEAVAVAAAVGVLLLAGAGGAAG

SEQ ID NO: 205396 - protein, 15 aa, Homo sapiens
MRLLILTCLVAVALA

SEQ ID NO: 205397 - protein, 23 aa, Homo sapiens
MGTSHPAFLVLGCLLTGLSLILC

SEQ ID NO: 205398 - protein, 16 aa, Homo sapiens
MGTWILFACLLGAAFA

SEQ ID NO: 205399 - protein, 16 aa, Homo sapiens
MRSTILLFCLLGSTRS

SEQ ID NO: 205400 - protein, 19 aa, Homo sapiens
MPALGWAVAAILMLQTAMA

SEQ ID NO: 205401 - protein, 17 aa, Homo sapiens
MLPGLALLLLAAWTARA

SEQ ID NO: 205402 - protein, 24 aa, Homo sapiens
MVMGLGVLLLVFVLGLGLTPPTLA

SEQ ID NO: 205403 - protein, 22 aa, Homo sapiens
MDSLASLVLCGVSLLLSGTVEG

SEQ ID NO: 205404 - protein, 16 aa, Homo sapiens
MFTIKLLLFIVPLVIS

SEQ ID NO: 205405 - protein, 26 aa, Homo sapiens
MLKKPLSAVTWLCIFIVAFVSHPAWL

SEQ ID NO: 205406 - protein, 31 aa, Homo sapiens
MGQGWATAGLPSLLFLLLCYGHPLLVPSQEA

SEQ ID NO: 205407 - protein, 33 aa, Homo sapiens
MRKRAPQSEMAPAGVSLRATILCLLAWAGLAAG

SEQ ID NO: 205408 - protein, 20 aa, Homo sapiens
MEKIPVSAFLLLVALSYTLA

SEQ ID NO: 205409 - protein, 21 aa, Homo sapiens
MMLHSALGLCLLLVTVSSNLA

SEQ ID NO: 205410 - protein, 25 aa, Homo sapiens
MKSSGLFPFLVLLALGTLAPWAVEG

SEQ ID NO: 205411 - protein, 32 aa, Homo sapiens
MYSNVIGTVTSGKRKVYLLSLLLIGFWDCVTC

SEQ ID NO: 205412 - protein, 18 aa, Homo sapiens
MKAAVLTLAVLFLTGSQA

SEQ ID NO: 205413 - protein, 18 aa, Homo sapiens
MKLLAATVLLLTICSLEG

SEQ ID NO: 205414 - protein, 20 aa, Homo sapiens
MFLKAVVLTLALVAVAGARA

SEQ ID NO: 205415 - protein, 27 aa, Homo sapiens
MDPPRPALLALLALPALLLLLLAGARA

SEQ ID NO: 205416 - protein, 22 aa, Homo sapiens
MGTRLLPALFLVLLVLGFEVQG

SEQ ID NO: 205417 - protein, 20 aa, Homo sapiens
MQPRVLLVVALLALLASARA

SEQ ID NO: 205418 - protein, 26 aa, Homo sapiens
MRLFLSLPVLVVVLSIVLEGPAPAQG

SEQ ID NO: 205419 - protein, 20 aa, Homo sapiens
MVMLLLLLSALAGLFGAAEG

SEQ ID NO: 205420 - protein, 18 aa, Homo sapiens
MKVLWAALLVTFLAGCQA

SEQ ID NO: 205421 - protein, 22 aa, Homo sapiens
MFHQIWAALLYFYGIILNSIYQ

SEQ ID NO: 205422 - protein, 19 aa, Homo sapiens
MEHKEVVLLLLLFLKSAAP

SEQ ID NO: 205423 - protein, 30 aa, Homo sapiens
MAPHGPGSLTTLVPWAAALLLALGVERALA

SEQ ID NO: 205424 - protein, 23 aa, Homo sapiens
MPSPGTVCSLLLLGMLWLDLAMA

SEQ ID NO: 205425 - protein, 18 aa, Homo sapiens
MGAPRSLLLALAAGLAVA

SEQ ID NO: 205426 - protein, 25 aa, Homo sapiens
MSSFSTTTVSFLLLLAFQLLGQTRA

SEQ ID NO: 205427 - protein, 32 aa, Homo sapiens
MPGPRRPAGSRLRLLLLLLLPPLLLLLRGSHA

SEQ ID NO: 205428 - protein, 26 aa, Homo sapiens
MTRLTVLALLAGLLASSRAGSSPLLD

SEQ ID NO: 205429 - protein, 31 aa, Homo sapiens
MRENMARGPCNAPRWVSLMVLVAIGTAVTAA

SEQ ID NO: 205430 - protein, 20 aa, Homo sapiens
MAWASRLGLLLALLLPVVGA

SEQ ID NO: 205431 - protein, 16 aa, Homo sapiens
MLLILLSVALLALSSA

SEQ ID NO: 205432 - protein, 16 aa, Homo sapiens
MLLILLSVALLALSSA

SEQ ID NO: 205433 - protein, 21 aa, Homo sapiens
MAAALFVLLGFALLGTHGASG

SEQ ID NO: 205434 - protein, 32 aa, Homo sapiens
MPGGPGVLQALPATIFLLFLLSAVYLGPGCQA

SEQ ID NO: 205435 - protein, 28 aa, Homo sapiens
MARLALSPVPSHWMVALLLLLSAEPVPA

SEQ ID NO: 205436 - protein, 31 aa, Homo sapiens
MSSWIRWHGPAMARLWGFCWLVVGFWRAAFA

SEQ ID NO: 205437 - protein, 19 aa, Homo sapiens
MISPVLILFSSFLCHVAIA

SEQ ID NO: 205438 - protein, 20 aa, Homo sapiens
MSRSVALAVLALLSLSGLEA

SEQ ID NO: 205439 - protein, 15 aa, Homo sapiens
MKVLILACLVALALA

SEQ ID NO: 205440 - protein, 22 aa, Homo sapiens
MRIHYLLFALLFLFLVPVPGHG

SEQ ID NO: 205441 - protein, 20 aa, Homo sapiens
MGLFMIIAILLFQKPTVTEQ

SEQ ID NO: 205442 - protein, 23 aa, Homo sapiens
MPGFLVRILLLLLVLLLLGPTRG

SEQ ID NO: 205443 - protein, 22 aa, Homo sapiens
MARGSAVAWAALGPLLWGCALG

SEQ ID NO: 205444 - protein, 22 aa, Homo sapiens
MTSSRLWFSLLLAAAFAGRATA

SEQ ID NO: 205445 - protein, 20 aa, Homo sapiens
MNVLLGSVVIFATFVTLCNA

SEQ ID NO: 205446 - protein, 20 aa, Homo sapiens
MAWQGLVLAACLLMFPSTTA

SEQ ID NO: 205447 - protein, 32 aa, Homo sapiens
MRLPGAMPALALKGELLLLSLLLLLEPQISQG

SEQ ID NO: 205448 - protein, 20 aa, Homo sapiens
MDRHSSYIFIWLQLELCAMA

SEQ ID NO: 205449 - protein, 16 aa, Homo sapiens
MKLPLLLALLFGAVSA

SEQ ID NO: 205450 - protein, 16 aa, Homo sapiens
MKTALILLSILGMACA

SEQ ID NO: 205451 - protein, 30 aa, Homo sapiens
MLRGTMTAWRGMRPEVTLACLLLATAGCFA

SEQ ID NO: 205452 - protein, 29 aa, Homo sapiens
MKMASSLAFLLLNFHVSLFLVQLLTPCSA

SEQ ID NO: 205453 - protein, 17 aa, Homo sapiens
MALMLSLVLSLLKLGSG

SEQ ID NO: 205454 - protein, 25 aa, Homo sapiens
MAGPAIHTAPMLFLVLLLPLELSLA

SEQ ID NO: 205455 - protein, 48 aa, Homo sapiens
MHPPKTPSGALHRKRKMAAWPFSRLWKVSDPILFQMTLIAALLPAVLG

SEQ ID NO: 205456 - protein, 17 aa, Homo sapiens
MFFWCACCLMVAWRVSA

SEQ ID NO: 205457 - protein, 22 aa, Homo sapiens
MEKKCTLYFLVLLPFFMILVTA

SEQ ID NO: 205458 - protein, 24 aa, Homo sapiens
MRFTFTSRCLALFLLLNHPTPILP

SEQ ID NO: 205459 - protein, 29 aa, Homo sapiens
MEAPGPRALRTALCGGCCCLLLCAQLAVA

SEQ ID NO: 205460 - protein, 28 aa, Homo sapiens
MLRRPAPALAPAARLLLAGLLCGGGVWA

SEQ ID NO: 205461 - protein, 19 aa, Homo sapiens
MDLRQFLMCLSLCTAFALS

SEQ ID NO: 205462 - protein, 18 aa, Homo sapiens
MRMLLALLALSAARPSAS

SEQ ID NO: 205463 - protein, 37 aa, Homo sapiens
MAPLCPSPWLPLLIPAPAPGLTVQLLLSLLLLVPVHP

SEQ ID NO: 205464 - protein, 26 aa, Homo sapiens
MRLHRLRARLSAVACGLLLLLVRGQG

SEQ ID NO: 205465 - protein, 16 aa, Homo sapiens
MRGLLVLSVLLGAVFG

SEQ ID NO: 205466 - protein, 15 aa, Homo sapiens
MLALLVLVTVALASA

SEQ ID NO: 205467 - protein, 17 aa, Homo sapiens
MDFPCLWLGLLLPLVAA

SEQ ID NO: 205468 - protein, 20 aa, Homo sapiens
MSDLLSVFLHLLLLFKLVAP

SEQ ID NO: 205469 - protein, 34 aa, Homo sapiens
MGHLSAPLHRVRVPWQGLLLTASLLTFWNPPTTA

SEQ ID NO: 205470 - protein, 34 aa, Homo sapiens
MGPPSAPPCRLHVPWKEVLLTASLLTFWNPPTTA

SEQ ID NO: 205471 - protein, 35 aa, Homo sapiens
MGSPSACPYRVCIPWQGLLLTASLLTFWNLPNSAQ

SEQ ID NO: 205472 - protein, 34 aa, Homo sapiens
MGPISAPSCRWRIPWQGLLLTASLFTFWNPPTTA

SEQ ID NO: 205473 - protein, 22 aa, Homo sapiens
MRVLSGTSLMLCSLLLLLQALC

SEQ ID NO: 205474 - protein, 18 aa, Homo sapiens
MQPSSLLPLALCLLAAPA

SEQ ID NO: 205475 - protein, 19 aa, Homo sapiens
MKTLLLLLLVLLELGEAQG

SEQ ID NO: 205476 - protein, 18 aa, Homo sapiens
MQPLLLLLAFLLPTGAEA

SEQ ID NO: 205477 - protein, 22 aa, Homo sapiens
MWATLPLLCAGAWLLGVPVCGA

SEQ ID NO: 205478 - protein, 21 aa, Homo sapiens
MALTAHPSCLLALLVAGLAQG

SEQ ID NO: 205479 - protein, 26 aa, Homo sapiens
MFPFYSCWRTGLLLLLLAVAVRESWQ

SEQ ID NO: 205480 - protein, 40 aa, Homo sapiens
MGAAAGRSPHLGPAPARRPQRSLLLLQLLLLVAAPGSTQA

SEQ ID NO: 205481 - protein, 23 aa, Homo sapiens
MQIITTALVCLLLAGMWPEDVDS

SEQ ID NO: 205482 - protein, 16 aa, Homo sapiens
MKVSAVLLCLLLMTAA

SEQ ID NO: 205483 - protein, 19 aa, Homo sapiens
MKISVAAIPFFLLITIALG

SEQ ID NO: 205484 - protein, 21 aa, Homo sapiens
MKVSVAALSCLMLVAVLGSQA

SEQ ID NO: 205485 - protein, 23 aa, Homo sapiens
MKVSEAALSLLVLILIITSASRS

SEQ ID NO: 205486 - protein, 23 aa, Homo sapiens
MAPLKMLALVTLLLGASLQHIHA

SEQ ID NO: 205487 - protein, 20 aa, Homo sapiens
MKGLAAALLVLVCTMALCSC

SEQ ID NO: 205488 - protein, 21 aa, Homo sapiens
MALLLALSLLVLWTSPAPTLS

SEQ ID NO: 205489 - protein, 23 aa, Homo sapiens
MKVSAALLCLLLIAATFIPQGLA

SEQ ID NO: 205490 - protein, 26 aa, Homo sapiens
MCCTKSLLLAALMSVLLLHLCGESEA

SEQ ID NO: 205491 - protein, 23 aa, Homo sapiens
MAQSLALSLLILVLAFGIPRTQG

SEQ ID NO: 205492 - protein, 24 aa, Homo sapiens
MARLQTALLVVLVLLAVALQATEA

SEQ ID NO: 205493 - protein, 21 aa, Homo sapiens
MKVSVAALSCLMLVTALGSQA

SEQ ID NO: 205494 - protein, 26 aa, Homo sapiens
MAGLMTIVTSLLFLGVCAHHIIPTGS

SEQ ID NO: 205495 - protein, 23 aa, Homo sapiens
MMGLSLASAVLLASLLSLHLGTA

SEQ ID NO: 205496 - protein, 24 aa, Homo sapiens
MKGPPTFCSLLLLSLLLSPDPTAA

SEQ ID NO: 205497 - protein, 23 aa, Homo sapiens
MQVSTAALAVLLCTMALCNQFSA

SEQ ID NO: 205498 - protein, 23 aa, Homo sapiens
MQVSTAALAVLLCTMALCNQVLS

SEQ ID NO: 205499 - protein, 23 aa, Homo sapiens
MKLCVTVLSLLMLVAAFCSPALS

SEQ ID NO: 205500 - protein, 23 aa, Homo sapiens
MKVSAAALAVILIATALCAPASA

SEQ ID NO: 205501 - protein, 23 aa, Homo sapiens
MKASAALLCLLLTAAAFSPQGLA

SEQ ID NO: 205502 - protein, 21 aa, Homo sapiens
MQGPPLLTAAHLLCVCTAALA

SEQ ID NO: 205503 - protein, 29 aa, Homo sapiens
MEAPGPRALRTALCGGCCCLLLCAQLAVA

SEQ ID NO: 205504 - protein, 29 aa, Homo sapiens
MEAPGPRALRTALCGGCCCLLLCAQLAVA

SEQ ID NO: 205505 - protein, 21 aa, Homo sapiens
MSAVLLLALLGFILPLPGVQA

SEQ ID NO: 205506 - protein, 23 aa, Homo sapiens
MAFDVSCFFWVVLFSAGCKVITS

SEQ ID NO: 205507 - protein, 18 aa, Homo sapiens
MDYPTLLLALLHVYRALC

SEQ ID NO: 205508 - protein, 19 aa, Homo sapiens
MARPHPWWLCVLGTLVGLS

SEQ ID NO: 205509 - protein, 28 aa, Homo sapiens
MLRRRGSPGMGVHVGAALGALWFCLTGA

SEQ ID NO: 205510 - protein, 35 aa, Homo sapiens
MSGGWMAQVGAWRTGALGLALLLLLGLGLGLEAAA

SEQ ID NO: 205511 - protein, 19 aa, Homo sapiens
MALLFSLILAICTRPGFLA

SEQ ID NO: 205512 - protein, 25 aa, Homo sapiens
MGIQGGSVLFGLLLVLAVFCHSGHS

SEQ ID NO: 205513 - protein, 19 aa, Homo sapiens
MSRGLQLLLLSCAYSLAPA

SEQ ID NO: 205514 - protein, 22 aa, Homo sapiens
MARGAALALLLFGLLGVLVAAP

SEQ ID NO: 205515 - protein, 24 aa, Homo sapiens
MGAPAASLLLLLLLFACCWAPGGA

SEQ ID NO: 205516 - protein, 21 aa, Homo sapiens
MVGKMWPVLWTLCAVRVTVDA

SEQ ID NO: 205517 - protein, 23 aa, Homo sapiens
MGLPRLVCAFLLAACCCCPRVAG

SEQ ID NO: 205518 - protein, 28 aa, Homo sapiens
MLCPWRTANLGLLLILTIFLVAASSSLC

SEQ ID NO: 205519 - protein, 17 aa, Homo sapiens
MHLLLFQLLVLLPLGKT

SEQ ID NO: 205520 - protein, 32 aa, Homo sapiens
MLGAKPHWLPGPLHSPGLPLVLVLLALGAGWA

SEQ ID NO: 205521 - protein, 27 aa, Homo sapiens
MGSGRRALSAVPAVLLVLTLPGLPVWA

SEQ ID NO: 205522 - protein, 19 aa, Homo sapiens
MKILILGIFLFLCSTPAWA

SEQ ID NO: 205523 - protein, 21 aa, Homo sapiens
MGVKASQTGFVVLVLLQCCSA

SEQ ID NO: 205524 - protein, 26 aa, Homo sapiens
MGATTMDQKSLWAGVVVLLLLQGGSA

SEQ ID NO: 205525 - protein, 21 aa, Homo sapiens
MVRSVAWAGFMVLLMIPWGSA

SEQ ID NO: 205526 - protein, 20 aa, Homo sapiens
MNSGVCLCVLMAVLAAGALT

SEQ ID NO: 205527 - protein, 17 aa, Homo sapiens
MLAATVLTLALLGNAHA

SEQ ID NO: 205528 - protein, 28 aa, Homo sapiens
MHSKVTIICIRFLFWFLLLCMLIGKSHT

SEQ ID NO: 205529 - protein, 25 aa, Homo sapiens
MVPEVRVLSSLLGLALLWFPLDSHA

SEQ ID NO: 205530 - protein, 20 aa, Homo sapiens
MEMFQGLLLLLLLSMGGTWA

SEQ ID NO: 205531 - protein, 26 aa, Homo sapiens
MAPGSRTSLLLAFALLCLPWLQEAGA

SEQ ID NO: 205532 - protein, 18 aa, Homo sapiens
MRSAAVLALLLCAGQVTA

SEQ ID NO: 205533 - protein, 19 aa, Homo sapiens
MLLLPLPLLLFLLCSRAEA

SEQ ID NO: 205534 - protein, 18 aa, Homo sapiens
MAFLWLLSCWALLGTTFG

SEQ ID NO: 205535 - protein, 22 aa, Homo sapiens
MMKTLLLFVGLLLTWESGQVLG

SEQ ID NO: 205536 - protein, 19 aa, Homo sapiens
MPLLTLYLLLFWLSGYSIA

SEQ ID NO: 205537 - protein, 18 aa, Homo sapiens
MRLLVLLWGCLLLPGYEA

SEQ ID NO: 205538 - protein, 28 aa, Homo sapiens
MFPGCPRLWVLVVLGTSWVGWGSQGTEA

SEQ ID NO: 205539 - protein, 19 aa, Homo sapiens
MQIELSTCFFLCLLRFCFS

SEQ ID NO: 205540 - protein, 18 aa, Homo sapiens
MIFLYQVVHFILFTSVSG

SEQ ID NO: 205541 - protein, 19 aa, Homo sapiens
MRALLLLGFLLVSLESTLS

SEQ ID NO: 205542 - protein, 20 aa, Homo sapiens
MRLKNLTFIIILIISGELYA

SEQ ID NO: 205543 - protein, 27 aa, Homo sapiens
MESSRVRLLPLLGAALLLMLPLLGTRA

SEQ ID NO: 205544 - protein, 17 aa, Homo sapiens
MEKILILLLVALSVAYA

SEQ ID NO: 205545 - protein, 21 aa, Homo sapiens
MAAALALVAGVLSGAVLPLWS

SEQ ID NO: 205546 - protein, 22 aa, Homo sapiens
MFSFVDLRLLLLLAATALLTHG

SEQ ID NO: 205547 - protein, 23 aa, Homo sapiens
MMSFVQKGSWLLLALLHPTIILA

SEQ ID NO: 205548 - protein, 27 aa, Homo sapiens
MGPRLSVWLLLLPAALLLHEEHSRAAA

SEQ ID NO: 205549 - protein, 23 aa, Homo sapiens
MKTCWKIPVFFFVCSFLEPWASA

SEQ ID NO: 205550 - protein, 19 aa, Homo sapiens
MRAARALLPLLLQACWTAA

SEQ ID NO: 205551 - protein, 21 aa, Homo sapiens
MWVSWAPGLWLLGLWATFGHG

SEQ ID NO: 205552 - protein, 25 aa, Homo sapiens
MGRDQRAVAGPALRRWLLLGTVTVG

SEQ ID NO: 205553 - protein, 26 aa, Homo sapiens
MMANWAEARPLLILIVLLGQFVSIKA

SEQ ID NO: 205554 - protein, 30 aa, Homo sapiens
MRPQGPAASPQRLRGLLLLLLLQLPAPSSA

SEQ ID NO: 205555 - protein, 22 aa, Homo sapiens
MEGPRGWLVLCVLAISLASMVT

SEQ ID NO: 205556 - protein, 25 aa, Homo sapiens
MKIPWGSIPVLMLLLLLGLIDISQA

SEQ ID NO: 205557 - protein, 28 aa, Homo sapiens
MDVGPSSLPHLGLKLLLLLLLLPLRGQA

SEQ ID NO: 205558 - protein, 15 aa, Homo sapiens
MRPLLVLLLLGLAAG

SEQ ID NO: 205559 - protein, 15 aa, Homo sapiens
MRPLLVLLLLGLAAG

SEQ ID NO: 205560 - protein, 27 aa, Homo sapiens
MVTAALGPVWAALLLFLLMCEIPMVEL

SEQ ID NO: 205561 - protein, 17 aa, Homo sapiens
MWLLYLLVPALFCRAGG

SEQ ID NO: 205562 - protein, 15 aa, Homo sapiens
MWCIVLFSLLAWVYA

SEQ ID NO: 205563 - protein, 20 aa, Homo sapiens
MGPLMVLFCLLFLYPGLADS

SEQ ID NO: 205564 - protein, 22 aa, Homo sapiens
MGPTSGPSLLLLLLTHLPLALG

SEQ ID NO: 205565 - protein, 19 aa, Homo sapiens
MRLLWGLIWASSFFTLSLQ

SEQ ID NO: 205566 - protein, 21 aa, Homo sapiens
MATSMGLLLLLLLLLTQPGAG

SEQ ID NO: 205567 - protein, 21 aa, Homo sapiens
MARRSVLYFILLNALINKGQA

SEQ ID NO: 205568 - protein, 22 aa, Homo sapiens
MKVISLFILVGFIGEFQSFSSA

SEQ ID NO: 205569 - protein, 20 aa, Homo sapiens
MLPPGTATLLTLLLAAGSLG

SEQ ID NO: 205570 - protein, 21 aa, Homo sapiens
MSACRSFAVAICILEISILTA

SEQ ID NO: 205571 - protein, 34 aa, Homo sapiens
MTVARPSVPAALPLLGELPRLLLLVLLCLPAVWG

SEQ ID NO: 205572 - protein, 25 aa, Homo sapiens
MGSNLSPQLCLMPFILGLLSGGVTT

SEQ ID NO: 205573 - protein, 17 aa, Homo sapiens
RLLAKIICLMLWAICVA

SEQ ID NO: 205574 - protein, 18 aa, Homo sapiens
MWLLVSVILISRISSVGG

SEQ ID NO: 205575 - protein, 18 aa, Homo sapiens
MKLLHVFLLFLCFHLRFC

SEQ ID NO: 205576 - protein, 41 aa, Homo sapiens
MGASSPRSPEPVGPPAPGLPFCCGGSLLAVVVLLALPVAWG

SEQ ID NO: 205577 - protein, 20 aa, Homo sapiens
MGAAGLLGVFLALVAPGVLG

SEQ ID NO: 205578 - protein, 20 aa, Homo sapiens
MKMWLLVSHLVIISITTCLA

SEQ ID NO: 205579 - protein, 30 aa, Homo sapiens
MGTATRRKPHLLLVAAVALVSSSAWSSALG

SEQ ID NO: 205580 - protein, 22 aa, Homo sapiens
MPLLLYTCLLWLPTSGLWTVQA

SEQ ID NO: 205581 - protein, 26 aa, Homo sapiens
MPRSCCSRSGALLLALLLQASMEVRG

SEQ ID NO: 205582 - protein, 23 aa, Homo sapiens
MGGHPQLRLVKALLLLGLNPVSA

SEQ ID NO: 205583 - protein, 24 aa, Homo sapiens
MSPNFKLQCHFILIFLTALRGESR

SEQ ID NO: 205584 - protein, 18 aa, Homo sapiens
MEKLLCFLVLTSLSHAFG

SEQ ID NO: 205585 - protein, 21 aa, Homo sapiens
MRLSVCLLLLTLALCCYRANA

SEQ ID NO: 205586 - protein, 20 aa, Homo sapiens
MKLAALLGLCVALSCSSAAA

SEQ ID NO: 205587 - protein, 21 aa, Homo sapiens
MQAAWLLGALVVPQLLGFGHG

SEQ ID NO: 205588 - protein, 21 aa, Homo sapiens
MRPAFALCLLWQALWPGPGGG

SEQ ID NO: 205589 - protein, 29 aa, Homo sapiens
MAGLNCGVSIALLGVLLLGAARLPRGAEA

SEQ ID NO: 205590 - protein, 21 aa, Homo sapiens
MNQTAILICCLIFLTLSGIQG

SEQ ID NO: 205591 - protein, 21 aa, Homo sapiens
MSVKGMAIALAVILCATVVQG

SEQ ID NO: 205592 - protein, 34 aa, Homo sapiens
MARATLSAAPSNPRLLRVALLLLLLVAASRRAAG

SEQ ID NO: 205593 - protein, 34 aa, Homo sapiens
MAHATLSAAPSNPRLLRVALLLLLLVAASRRAAG

SEQ ID NO: 205594 - protein, 36 aa, Homo sapiens
MSLLSSRAARVPGPSSSLCALLVLLLLLTQPGPIAS

SEQ ID NO: 205595 - protein, 37 aa, Homo sapiens
MSLPSSRAARVPGPSGSLCALLALLLLLTPPGPLASA

SEQ ID NO: 205596 - protein, 22 aa, Homo sapiens
MKKSGVLFLLGIILLVLIGVQG

SEQ ID NO: 205597 - protein, 28 aa, Homo sapiens
MSSPQRRKAMPWALSLLLMGFQLLVTYA

SEQ ID NO: 205598 - protein, 28 aa, Homo sapiens
MLGLPWKGGLSWALLLLLLGSQILLIYA

SEQ ID NO: 205599 - protein, 26 aa, Homo sapiens
MAGPLRAPLLLLAILAVALAVSPAAG

SEQ ID NO: 205600 - protein, 20 aa, Homo sapiens
MMWPMHTPLLLLTALMVAVA

SEQ ID NO: 205601 - protein, 20 aa, Homo sapiens
MARPLCTLLLLMATLAGALA

SEQ ID NO: 205602 - protein, 20 aa, Homo sapiens
MAWPLCTLLLLLATQAVALA

SEQ ID NO: 205603 - protein, 20 aa, Homo sapiens
MAQHLSTLLLLLATLAVALA

SEQ ID NO: 205604 - protein, 34 aa, Homo sapiens
MYLVAGDRGLAGCGHLLVSLLGLLLLLARSGTRA

SEQ ID NO: 205605 - protein, 21 aa, Homo sapiens
MEIKHLLFLVAAACLLPMLSM

SEQ ID NO: 205606 - protein, 24 aa, Homo sapiens
MRLPRRAALGLLPLLLLLPPAPEA

SEQ ID NO: 205607 - protein, 22 aa, Homo sapiens
MLKPSLPFTSLLFLQLPLLGVG

SEQ ID NO: 205608 - protein, 37 aa, Homo sapiens
MPAGRRGPAAQSARRPPPLLPLLLLLCVLGAPRAGSG

SEQ ID NO: 205609 - protein, 21 aa, Homo sapiens
MRLLILALLGICSLTAYIVEG

SEQ ID NO: 205610 - protein, 22 aa, Homo sapiens
MRTPGPLPVLLLLLAGAPAARP

SEQ ID NO: 205611 - protein, 23 aa, Homo sapiens
MTATEALLRVLLLLLAFGHSTYG

SEQ ID NO: 205612 - protein, 26 aa, Homo sapiens
MAAASRSASGWALLLLVALWQQRAAG

SEQ ID NO: 205613 - protein, 22 aa, Homo sapiens
MRGMKLLGALLALAALLQGAVS

SEQ ID NO: 205614 - protein, 19 aa, Homo sapiens
MRFMTLLFLTALAGALVCA

SEQ ID NO: 205615 - protein, 21 aa, Homo sapiens
MKFQGPLACLLLALCLGSGEA

SEQ ID NO: 205616 - protein, 31 aa, Homo sapiens
MMALGAAGATRVFVAMVAAALGGHPLLGVSA

SEQ ID NO: 205617 - protein, 21 aa, Homo sapiens
MQRLGATLLCLLLAAAVPTAP

SEQ ID NO: 205618 - protein, 18 aa, Homo sapiens
MVAAVLLGLSWLCSPLGA

SEQ ID NO: 205619 - protein, 16 aa, Homo sapiens
MWSGWWLWPLVAVCTA

SEQ ID NO: 205620 - protein, 24 aa, Homo sapiens
MGAGPSLLLAALLLLLSGDGAVRC

SEQ ID NO: 205621 - protein, 22 aa, Homo sapiens
MAPPGSSTVFLLALTIIASTWA

SEQ ID NO: 205622 - protein, 23 aa, Homo sapiens
MEAPAAGLFLLLLLGTWAPAPGS

SEQ ID NO: 205623 - protein, 22 aa, Homo sapiens
MAPPGSSTVFLLALTIIASTWA

SEQ ID NO: 205624 - protein, 25 aa, Homo sapiens
MASLFRSYLPAIWLLLSQLLRESLA

SEQ ID NO: 205625 - protein, 21 aa, Homo sapiens
MRGLAVLLTVALATLLAPGAG

SEQ ID NO: 205626 - protein, 25 aa, Homo sapiens
MGSRAELCTLLGGFSFLLLLIPGEG

SEQ ID NO: 205627 - protein, 22 aa, Homo sapiens
MRASSFLIVVVFLIAGTLVLEA

SEQ ID NO: 205628 - protein, 16 aa, Homo sapiens
MIRTLLLSTLVAGALS

SEQ ID NO: 205629 - protein, 16 aa, Homo sapiens
MIRTLLLSTLVAGALS

SEQ ID NO: 205630 - protein, 25 aa, Homo sapiens
MDRGTLPLAVALLLASCSLSPTSLA

SEQ ID NO: 205631 - protein, 32 aa, Homo sapiens
MAAAVPRAAFLSPLLPLLLGFLLLSAPHGGSG

SEQ ID NO: 205632 - protein, 21 aa, Homo sapiens
MRALWVLGLCCVLLTFGSVRA

SEQ ID NO: 205633 - protein, 29 aa, Homo sapiens
MISLPGPLVTNLLRFLFLGLSALAPPSRA

SEQ ID NO: 205634 - protein, 17 aa, Homo sapiens
MDYLLMIFSLLFVACQG

SEQ ID NO: 205635 - protein, 27 aa, Homo sapiens
MVPKLFTSQICLLLLLGLMGVEGSLHA

SEQ ID NO: 205636 - protein, 23 aa, Homo sapiens
MKVSAALLWLLLIAAAFSPQGLA

SEQ ID NO: 205637 - protein, 20 aa, Homo sapiens
MDCQLSILLLLSCSVLDSFG

SEQ ID NO: 205638 - protein, 17 aa, Homo sapiens
MALDYLLLLLLASAVAA

SEQ ID NO: 205639 - protein, 16 aa, Homo sapiens
MVCSLWVLLLVSSVLA

SEQ ID NO: 205640 - protein, 18 aa, Homo sapiens
MEFLWAPLLGLCCSLAAA

SEQ ID NO: 205641 - protein, 25 aa, Homo sapiens
MRLLPLLRTVLWAAFLGSPLRGGSS

SEQ ID NO: 205642 - protein, 27 aa, Homo sapiens
MARPGQRWLGKWLVAMVVWALCRLATP

SEQ ID NO: 205643 - protein, 27 aa, Homo sapiens
MGPPHSGPGGVRVGALLLLGVLGLVSG

SEQ ID NO: 205644 - protein, 24 aa, Homo sapiens
MRPSGTAGAALLALLAALCPASRA

SEQ ID NO: 205645 - protein, 22 aa, Homo sapiens
MALGVPISVYLLFNAMTALTEE

SEQ ID NO: 205646 - protein, 23 aa, Homo sapiens
MGRGWGFLFGLLGAVWLLSSGHG

SEQ ID NO: 205647 - protein, 27 aa, Homo sapiens
MGVHECPAWLWLLLSLLSLPLGLPVLG

SEQ ID NO: 205648 - protein, 24 aa, Homo sapiens
MDHLGASLWPQVGSLCLLLAGAAW

SEQ ID NO: 205649 - protein, 21 aa, Homo sapiens
MIASQFLSALTLVLLIKESGA

SEQ ID NO: 205650 - protein, 18 aa, Homo sapiens
MLALLCSCLLLAAGASDA

SEQ ID NO: 205651 - protein, 27 aa, Homo sapiens
MKLGCVLMAWALYLSLGVLWVAQMLLA

SEQ ID NO: 205652 - protein, 16 aa, Homo sapiens
MLPRLLLLICAPLCEP

SEQ ID NO: 205653 - protein, 19 aa, Homo sapiens
MLLWSLLVIFDAVTEQADS

SEQ ID NO: 205654 - protein, 19 aa, Homo sapiens
MFSMRIVCLVLSVVGTAWT

SEQ ID NO: 205655 - protein, 30 aa, Homo sapiens
MKRMVSWSFHKLKTMKHLLLLLLCVFLVKS

SEQ ID NO: 205656 - protein, 26 aa, Homo sapiens
MSWSLHPRNLILYFYALLFLSSTCVA

SEQ ID NO: 205657 - protein, 24 aa, Homo sapiens
MRSGCVVVHVWILAGLWLAVAGRP

SEQ ID NO: 205658 - protein, 28 aa, Homo sapiens
MDSDETGFEHSGLWVSVLAGLLLGACQA

SEQ ID NO: 205659 - protein, 24 aa, Homo sapiens
MLGARLRLWVCALCSVCSMSVLRA

SEQ ID NO: 205660 - protein, 22 aa, Homo sapiens
MGAPACALALCVAVAIVAGASS

SEQ ID NO: 205661 - protein, 21 aa, Homo sapiens
MRLLLALLGVLLSVPGPPVLS

SEQ ID NO: 205662 - protein, 24 aa, Homo sapiens
MTPSPLLLLLLPPLLLGAFPPAAA

SEQ ID NO: 205663 - protein, 31 aa, Homo sapiens
MLRGPGPGLLLLAVQCLGTAVPSTGASKSKR

SEQ ID NO: 205664 - protein, 29 aa, Homo sapiens
MERAAPSRRVPLPLLLLGGLALLAAGVDA

SEQ ID NO: 205665 - protein, 29 aa, Homo sapiens
MELSGATMARGLAVLLVLFLHIKNLPAQA

SEQ ID NO: 205666 - protein, 23 aa, Homo sapiens
MDLLWILPSLWLLLLGGPACLKT

SEQ ID NO: 205667 - protein, 19 aa, Homo sapiens
MRLFLWNAVLTLFVTSLIG

SEQ ID NO: 205668 - protein, 21 aa, Homo sapiens
MRLSWFRVLTVLSICLSAVAT

SEQ ID NO: 205669 - protein, 16 aa, Homo sapiens
MVWKWMPLLLLLVCVA

SEQ ID NO: 205670 - protein, 29 aa, Homo sapiens
MVRARHQPGGLCLLLLLLCQFMEDRSAQA

SEQ ID NO: 205671 - protein, 20 aa, Homo sapiens
MWKRWLALALALVAVAWVRA

SEQ ID NO: 205672 - protein, 26 aa, Homo sapiens
MRPGAPGPLWPLPWGALAWAVGFVSS

SEQ ID NO: 205673 - protein, 18 aa, Homo sapiens
MKTLQFFFLFCCWKAICC

SEQ ID NO: 205674 - protein, 24 aa, Homo sapiens
MAPISLSWLLRLATFCHLTVLLAG

SEQ ID NO: 205675 - protein, 22 aa, Homo sapiens
MAMTWIVFSLWPLTVFMGHIGG

SEQ ID NO: 205676 - protein, 20 aa, Homo sapiens
METPAQLLFLLLLWLPDTTG

SEQ ID NO: 205677 - protein, 26 aa, Homo sapiens
MTAAAGSAGRAAVPLLLCALLAPGGA

SEQ ID NO: 205678 - protein, 18 aa, Homo sapiens
MTPPRLFWVWLLVAGTQG

SEQ ID NO: 205679 - protein, 19 aa, Homo sapiens
MWLLLTMASLISVLGTTHG

SEQ ID NO: 205680 - protein, 16 aa, Homo sapiens
MKWMVVVLVCLQLLEA

SEQ ID NO: 205681 - protein, 21 aa, Homo sapiens
MQRLCVYVLIFALALAAFSEA

SEQ ID NO: 205682 - protein, 23 aa, Homo sapiens
MRGSELPLVLLALVLCLAPRGRA

SEQ ID NO: 205683 - protein, 31 aa, Homo sapiens
MVRPLNPRPLPPVVLMLLLLLPPSPLPLAAG

SEQ ID NO: 205684 - protein, 27 aa, Homo sapiens
MAPHRPAPALLCALSLALCALSLPVRA

SEQ ID NO: 205685 - protein, 19 aa, Homo sapiens
MNWHLPLFLLASVTLPSIC

SEQ ID NO: 205686 - protein, 22 aa, Homo sapiens
MALKNKFSCLWILGLCLVATTS

SEQ ID NO: 205687 - protein, 20 aa, Homo sapiens
MKSIYFVAGLFVMLVQGSWQ

SEQ ID NO: 205688 - protein, 14 aa, Homo sapiens
MLLPLLLLLPMCWA

SEQ ID NO: 205689 - protein, 39 aa, Homo sapiens
MEFSSPSREECPKPLSRVSIMAGSLTGLLLLQAVSWASG

SEQ ID NO: 205690 - protein, 18 aa, Homo sapiens
MLCLLLTLGVALVCGVPA

SEQ ID NO: 205691 - protein, 19 aa, Homo sapiens
MYGKIIFVLLLSAIVSISA

SEQ ID NO: 205692 - protein, 19 aa, Homo sapiens
MYGKIIFVLLLSEIVSISA

SEQ ID NO: 205693 - protein, 19 aa, Homo sapiens
MYGKIIFVLLLSGIVSISA

SEQ ID NO: 205694 - protein, 24 aa, Homo sapiens
MDYYRKYAAIFLVTLSVFLHVLHS

SEQ ID NO: 205695 - protein, 23 aa, Homo sapiens
MELRARGWWLLCAAAALVACARG

SEQ ID NO: 205696 - protein, 21 aa, Homo sapiens
MAAAMPLALLVLLLLGPGGWC

SEQ ID NO: 205697 - protein, 27 aa, Homo sapiens
MAVTDSLSRAATVLATVLLLSFGSVAA

SEQ ID NO: 205698 - protein, 25 aa, Homo sapiens
MTPQSLLQTTLFLLSLLFLVQGAHG

SEQ ID NO: 205699 - protein, 24 aa, Homo sapiens
MARLGNCSLTWAALIILLLPGSLE

SEQ ID NO: 205700 - protein, 17 aa, Homo sapiens
MWLQSLLLLGTVACSIS

SEQ ID NO: 205701 - protein, 22 aa, Homo sapiens
MLLLVTSLLLCELPHPAFLLIP

SEQ ID NO: 205702 - protein, 26 aa, Homo sapiens
MRNSYRFLASSLSVVVSLLLIPEDVC

SEQ ID NO: 205703 - protein, 18 aa, Homo sapiens
MQPILLLLAFLLLPRADA

SEQ ID NO: 205704 - protein, 18 aa, Homo sapiens
MQPFLLLLAFLLTPGAGT

SEQ ID NO: 205705 - protein, 24 aa, Homo sapiens
MSRTAYTVGALLLLLGTLLPAAEG

SEQ ID NO: 205706 - protein, 19 aa, Homo sapiens
MKLASGFLVLWLSLGGGLA

SEQ ID NO: 205707 - protein, 26 aa, Homo sapiens
MAAGSRTSLLLAFGLLCLSWLQEGSA

SEQ ID NO: 205708 - protein, 34 aa, Homo sapiens
MARAALSAAPSNPRLLRVALLLLLLVAAGRRAAG

SEQ ID NO: 205709 - protein, 21 aa, Homo sapiens
MNAFLLFALCLLGAWAALAGG

SEQ ID NO: 205710 - protein, 18 aa, Homo sapiens
MSALGAVIALLLWGQLFA

SEQ ID NO: 205711 - protein, 31 aa, Homo sapiens
MLVRRGARAGPRMPRGWTALCLLSLLPSGFM

SEQ ID NO: 205712 - protein, 23 aa, Homo sapiens
MARVLGAPVALGLWSLCWSLAIA

SEQ ID NO: 205713 - protein, 35 aa, Homo sapiens
MLLRSKPALPPPLMLLLLGPLGPLSPGALPRPAQA

SEQ ID NO: 205714 - protein, 19 aa, Homo sapiens
MKHSLNALLIFLIITSAWG

SEQ ID NO: 205715 - protein, 22 aa, Homo sapiens
MDTSPLCFSILLVLCIFIQSSA

SEQ ID NO: 205716 - protein, 31 aa, Homo sapiens
MWVTKLLPALLLQHVLLHLLLLPIAIPYAEG

SEQ ID NO: 205717 - protein, 35 aa, Homo sapiens
MGRWAWVPSPWPPPGLGPFLLLLLLLLLLPRGFQP

SEQ ID NO: 205718 - protein, 22 aa, Homo sapiens
MGPRARPALLLLMLLQTAVLQG

SEQ ID NO: 205719 - protein, 15 aa, Homo sapiens
MWFLTTLLLWVPVDG

SEQ ID NO: 205720 - protein, 19 aa, Homo sapiens
MKFFVFALVLALMISMISA

SEQ ID NO: 205721 - protein, 19 aa, Homo sapiens
MKFFVFALILALMLSMTGA

SEQ ID NO: 205722 - protein, 18 aa, Homo sapiens
MKALIAALLLITLQYSCA

SEQ ID NO: 205723 - protein, 24 aa, Homo sapiens
MAVMAPRTLLLLLSGALALTQTWA

SEQ ID NO: 205724 - protein, 24 aa, Homo sapiens
MAVMAPRTLLLLLSGALALTQTWA

SEQ ID NO: 205725 - protein, 24 aa, Homo sapiens
MAVMAPRTLVLLLSGALALTQTWA

SEQ ID NO: 205726 - protein, 24 aa, Homo sapiens
MAVMAPRTLVLLLSGALALTQTWA

SEQ ID NO: 205727 - protein, 24 aa, Homo sapiens
MAVMAPRTLVLLLSGALALTQTWA

SEQ ID NO: 205728 - protein, 24 aa, Homo sapiens
MAVMAPRTLVLLLSGALALTQTWA

SEQ ID NO: 205729 - protein, 24 aa, Homo sapiens
MAVMAPRTLLLLLSGALALTHTWA

SEQ ID NO: 205730 - protein, 24 aa, Homo sapiens
MAVMAPRTLLLLLLGALALTQTWA

SEQ ID NO: 205731 - protein, 24 aa, Homo sapiens
MAVMAPRTLLLLLLGALALTQTWA

SEQ ID NO: 205732 - protein, 24 aa, Homo sapiens
MAIMAPRTLVLLLSGALALTQTWA

SEQ ID NO: 205733 - protein, 24 aa, Homo sapiens
MAVMAPRTLVLLLSGALALTQTWA

SEQ ID NO: 205734 - protein, 24 aa, Homo sapiens
MAVMPPRTLLLLLSGALALTQTWA

SEQ ID NO: 205735 - protein, 21 aa, Homo sapiens
MVDGTLLLLLSEALALTQTWA

SEQ ID NO: 205736 - protein, 21 aa, Homo sapiens
MAPRSLLLLLSGALALTDTWA

SEQ ID NO: 205737 - protein, 24 aa, Homo sapiens
MRVTAPRTVLLLLSGALALTETWA

SEQ ID NO: 205738 - protein, 24 aa, Homo sapiens
MRVTAPRTLLLLLWGAVALTETWA

SEQ ID NO: 205739 - protein, 24 aa, Homo sapiens
MRVTAPRTLLLLLWGAVALTETWA

SEQ ID NO: 205740 - protein, 24 aa, Homo sapiens
MRVTAPRTVLLLLSAALALTETWA

SEQ ID NO: 205741 - protein, 24 aa, Homo sapiens
MRVTAPRTLLLLLWGAVALTETWA

SEQ ID NO: 205742 - protein, 24 aa, Homo sapiens
MLVMAPRTVLLLLSAALALTETWA

SEQ ID NO: 205743 - protein, 24 aa, Homo sapiens
MRVTAPRTVLLLLWGAVALTETWA

SEQ ID NO: 205744 - protein, 24 aa, Homo sapiens
MRVTAPRTVLLLLWGAVALTETWA

SEQ ID NO: 205745 - protein, 24 aa, Homo sapiens
MRVTAPRTLLLLLWGALALTETWA

SEQ ID NO: 205746 - protein, 24 aa, Homo sapiens
MLVMAPRTVLLLLSAALALTETWA

SEQ ID NO: 205747 - protein, 24 aa, Homo sapiens
MRVTAPRTVLLLLWGAVALTETWA

SEQ ID NO: 205748 - protein, 23 aa, Homo sapiens
RVTAPRTLLLLLWGALALTETWA

SEQ ID NO: 205749 - protein, 24 aa, Homo sapiens
MRVMEPRTLILLLSGALALTETWA

SEQ ID NO: 205750 - protein, 24 aa, Homo sapiens
MRVMAPRTLILLLSGALALTETWA

SEQ ID NO: 205751 - protein, 24 aa, Homo sapiens
MRVMAPRTLLLLLSGALALTETWA

SEQ ID NO: 205752 - protein, 24 aa, Homo sapiens
MRVMAPRTLILLLSGALALTETWA

SEQ ID NO: 205753 - protein, 24 aa, Homo sapiens
MRVMAPQALLLLLSGALALIETWA

SEQ ID NO: 205754 - protein, 24 aa, Homo sapiens
MRVMAPRALLLLLSGGLALTETWA

SEQ ID NO: 205755 - protein, 24 aa, Homo sapiens
MRVMAPRTLILLLSGALALTETWA

SEQ ID NO: 205756 - protein, 24 aa, Homo sapiens
MRVMAPRTLILLLSGALALTETWA

SEQ ID NO: 205757 - protein, 24 aa, Homo sapiens
MRVMAPRTLILLLSGALALTETWA

SEQ ID NO: 205758 - protein, 24 aa, Homo sapiens
MRVMAPRALLLLLSGGLALTETWA

SEQ ID NO: 205759 - protein, 25 aa, Homo sapiens
GSGWVPWVVALLVNLTRLDSSMTQG

SEQ ID NO: 205760 - protein, 28 aa, Homo sapiens
MRPEDRMFHIRAVILRALSLAFLLSLRG

SEQ ID NO: 205761 - protein, 29 aa, Homo sapiens
MMVLQVSAAPRTVALTALLMVLLTSVVQG

SEQ ID NO: 205762 - protein, 23 aa, Homo sapiens
MILNKALMLGALALTTVMSPCGG

SEQ ID NO: 205763 - protein, 32 aa, Homo sapiens
MSWKKALRIPGGLRAATVTLMLSMLSTPVAEG

SEQ ID NO: 205764 - protein, 23 aa, Homo sapiens
MILNKALMLGALALTTVMSPCGG

SEQ ID NO: 205765 - protein, 32 aa, Homo sapiens
MSWKKALRIPGGLRVATVTLMLAMLSTPVAEG

SEQ ID NO: 205766 - protein, 23 aa, Homo sapiens
MILNKALLLGALALTTVMSPCGG

SEQ ID NO: 205767 - protein, 23 aa, Homo sapiens
MILNKALLLGALALTAVMSPCGG

SEQ ID NO: 205768 - protein, 32 aa, Homo sapiens
MSWKKSLRIPGDLRVATVTLMLAILSSSLAEG

SEQ ID NO: 205769 - protein, 23 aa, Homo sapiens
MILNKALMLGSLALTTVMSPCGG

SEQ ID NO: 205770 - protein, 32 aa, Homo sapiens
MSWKKALRIPGGLRVATVTLMLAMLSTSVAEG

SEQ ID NO: 205771 - protein, 32 aa, Homo sapiens
MSWKKALRIPGDLRVATVTLMLAMLSSLLAEG

SEQ ID NO: 205772 - protein, 25 aa, Homo sapiens
MAISGVPVLGFFIIAVLMSAQESWA

SEQ ID NO: 205773 - protein, 29 aa, Homo sapiens
MVCLRLPGGSCMAVLTVTLMVLSSPLALA

SEQ ID NO: 205774 - protein, 29 aa, Homo sapiens
MVCLRLPGGSCMAVLTVTLMVLSSPLALA

SEQ ID NO: 205775 - protein, 29 aa, Homo sapiens
MVCLKLPGGSCMTALTVTLMVLSSPLALA

SEQ ID NO: 205776 - protein, 29 aa, Homo sapiens
MVCLRLPGGSCMAVLTVTLMVLSSPLALA

SEQ ID NO: 205777 - protein, 29 aa, Homo sapiens
MVCLRLPGGSCMAVLTVTLMVLSSPLALA

SEQ ID NO: 205778 - protein, 29 aa, Homo sapiens
MVCLKFPGGSCMAALTVTLMVLSSPLALA

SEQ ID NO: 205779 - protein, 29 aa, Homo sapiens
MVCLKLPGGSCMAALTVTLMVLSSPLALA

SEQ ID NO: 205780 - protein, 29 aa, Homo sapiens
MVCLKLPGGSCMAALTVTLMVLSSPLALA

SEQ ID NO: 205781 - protein, 29 aa, Homo sapiens
MVCLKLPGGSSLAALTVTLMVLSSRLAFA

SEQ ID NO: 205782 - protein, 29 aa, Homo sapiens
MVCLKLPGGSCMAALTVTLTVLSSPLALA

SEQ ID NO: 205783 - protein, 32 aa, Homo sapiens
MSWKMALQIPGGFWAAAVTVMLVMLSTPVAEA

SEQ ID NO: 205784 - protein, 23 aa, Homo sapiens
MILNKALMLGALALTTVMSPCGG

SEQ ID NO: 205785 - protein, 23 aa, Homo sapiens
MFARMSDLHVLLLMALVGKTACG

SEQ ID NO: 205786 - protein, 19 aa, Homo sapiens
MDWTWRVFCLLAVAPGAHS

SEQ ID NO: 205787 - protein, 19 aa, Homo sapiens
  MOD_RES (5)..(8): Any amino acid
MDWTXXXXFLVAAATRVHS

SEQ ID NO: 205788 - protein, 19 aa, Homo sapiens
MDWTWRILFLVAAATGAHS

SEQ ID NO: 205789 - protein, 19 aa, Homo sapiens
MKHLWFLLLWCQLPDVGVL

SEQ ID NO: 205790 - protein, 19 aa, Homo sapiens
MDILCSTLLLLTVPSGVLS

SEQ ID NO: 205791 - protein, 19 aa, Homo sapiens
MEFGLSWLFLVAILKGVQC

SEQ ID NO: 205792 - protein, 20 aa, Homo sapiens
MGSQVHLLSFLLLWISDTRA

SEQ ID NO: 205793 - protein, 22 aa, Homo sapiens
MDMRVPAQLLGLLLLWLRRVRC

SEQ ID NO: 205794 - protein, 22 aa, Homo sapiens
MDMRVPAQLLGLLLLWLPGAKC

SEQ ID NO: 205795 - protein, 22 aa, Homo sapiens
MDMRVPAQLLGLLLLWLRGARC

SEQ ID NO: 205796 - protein, 4 aa, Homo sapiens
GSSG

SEQ ID NO: 205797 - protein, 20 aa, Homo sapiens
MRLPAQLLGLLMLWVPGSSG

SEQ ID NO: 205798 - protein, 20 aa, Homo sapiens
MEAPAQLLFLLLLWLPDTTG

SEQ ID NO: 205799 - protein, 20 aa, Homo sapiens
METPAQLLFLLLLWLPDTTG

SEQ ID NO: 205800 - protein, 20 aa, Homo sapiens
METPAQLLFLLLLWLPDTTG

SEQ ID NO: 205801 - protein, 4 aa, Homo sapiens
VPSG

SEQ ID NO: 205802 - protein, 20 aa, Homo sapiens
MEAPAQLLFLLLLWLPDTTG

SEQ ID NO: 205803 - protein, 20 aa, Homo sapiens
MEAPAQLLFLLLLWLPDTTR

SEQ ID NO: 205804 - protein, 20 aa, Homo sapiens
MVLQTQVFISLLLWISGAYG

SEQ ID NO: 205805 - protein, 20 aa, Homo sapiens
MVLQTQVFISLLLWISGAYG

SEQ ID NO: 205806 - protein, 20 aa, Homo sapiens
MVLQTQVFISLLLWISGAYG

SEQ ID NO: 205807 - protein, 20 aa, Homo sapiens
MAWTPLFLFLLTCCPGGSNS

SEQ ID NO: 205808 - protein, 19 aa, Homo sapiens
MTCSPLLLTLLIHCTGSWA

SEQ ID NO: 205809 - protein, 19 aa, Homo sapiens
MAWAPLLLTLLAHCTDCWA

SEQ ID NO: 205810 - protein, 23 aa, Homo sapiens
MGVPRPQPWALGLLLFLLPGSLG

SEQ ID NO: 205811 - protein, 18 aa, Homo sapiens
MVLHLLLFLLLTPQGGHS

SEQ ID NO: 205812 - protein, 24 aa, Homo sapiens
MALWMRLLPLLALLALWGPDPAAA

SEQ ID NO: 205813 - protein, 24 aa, Homo sapiens
MAPRGCIVAVFAIFCISRLLCSHG

SEQ ID NO: 205814 - protein, 24 aa, Homo sapiens
MRPRCCILALVCWITVFLLQCSKG

SEQ ID NO: 205815 - protein, 27 aa, Homo sapiens
MGTGGRRGAAAAPLLVAVAALLLGAAG

SEQ ID NO: 205816 - protein, 20 aa, Homo sapiens
MDPRLPAWALVLLGPALVFA

SEQ ID NO: 205817 - protein, 30 aa, Homo sapiens
MKSGSGGGSPTSLWGLLFLSAALSLWPTSG

SEQ ID NO: 205818 - protein, 24 aa, Homo sapiens
MGIPMGKSMLVLLTFLAFASCCIA

SEQ ID NO: 205819 - protein, 25 aa, Homo sapiens
MSEVPVARVWLVLLLLTVQVGVTAG

SEQ ID NO: 205820 - protein, 39 aa, Homo sapiens
MLPRVGCPALPLPPPPLLPLLPLLLLLLGASGGGGGARA

SEQ ID NO: 205821 - protein, 27 aa, Homo sapiens
MQRARPTLWAAALTLLVLLRGPPVARA

SEQ ID NO: 205822 - protein, 21 aa, Homo sapiens
MLPLCLVAALLLAAGPGPSLG

SEQ ID NO: 205823 - protein, 26 aa, Homo sapiens
MERPSLRALLLGAAGLLLLLLPLSSS

SEQ ID NO: 205824 - protein, 27 aa, Homo sapiens
MALRKGGLALALLLLSWVALGPRSLEG

SEQ ID NO: 205825 - protein, 22 aa, Homo sapiens
MKGSIFTLFLFSVLFAISEVRS

SEQ ID NO: 205826 - protein, 29 aa, Homo sapiens
MGPERTGAAPLPLLLVLALSQGILNCCLA

SEQ ID NO: 205827 - protein, 32 aa, Homo sapiens
MGPGPSRAPRAPRLMLCALALMVAAGGCVVSA

SEQ ID NO: 205828 - protein, 39 aa, Homo sapiens
MFPTESAWLGKRGANPGPEAAVRETVMLLLCLGVPTGRP

SEQ ID NO: 205829 - protein, 41 aa, Homo sapiens
MGSRTPESPLHAVQLRWGPRRRPPLLPLLLLLLPPPPRVGG

SEQ ID NO: 205830 - protein, 23 aa, Homo sapiens
MAAAGQLCLLYLSAGLLSRLGAA

SEQ ID NO: 205831 - protein, 33 aa, Homo sapiens
MAGARSRDPWGASGICYLFGSLLVELLFSRAVA

SEQ ID NO: 205832 - protein, 18 aa, Homo sapiens
MWLFHTLLCIASLALLAA

SEQ ID NO: 205833 - protein, 31 aa, Homo sapiens
MARALCPLQALWLLEWVLLLLGPCAAPPAWA

SEQ ID NO: 205834 - protein, 31 aa, Homo sapiens; identical to SEQ ID NO: 205833

SEQ ID NO: 205835 - protein, 25 aa, Homo sapiens
MKDSCITVMAMALLSGFFFFAPASS

SEQ ID NO: 205836 - protein, 16 aa, Homo sapiens
MALRVLLLTALTLCHG

SEQ ID NO: 205837 - protein, 30 aa, Homo sapiens
MAFPPRRRLRLGPRGLPLLLSGLLLPLCRA

SEQ ID NO: 205838 - protein, 19 aa, Homo sapiens
MTRTRAALLLFTALATSLG

SEQ ID NO: 205839 - protein, 20 aa, Homo sapiens
MNLQPIFWIGLISSVCCVFA

SEQ ID NO: 205840 - protein, 22 aa, Homo sapiens
MLGLRPPLLALVGLLSLGCVLS

SEQ ID NO: 205841 - protein, 22 aa, Homo sapiens
MLGLRPPLLALVGLLSLGCVLS

SEQ ID NO: 205842 - protein, 27 aa, Homo sapiens
MAGPRPSPWARLLLAALISVSLSGTLA

SEQ ID NO: 205843 - protein, 19 aa, Homo sapiens
MVALPMVLVLLLVLSRGES

SEQ ID NO: 205844 - protein, 18 aa, Homo sapiens
MNQLSFLLFLIATTRGWS

SEQ ID NO: 205845 - protein, 28 aa, Homo sapiens
MKPPRPVRTCSKVLVLLSLLAIHQTTTA

SEQ ID NO: 205846 - protein, 27 aa, Homo sapiens
MAPSSPRPALPALLVLLGALFPGPGNA

SEQ ID NO: 205847 - protein, 23 aa, Homo sapiens
MASPFALLMVLVVLSCKSSCSLG

SEQ ID NO: 205848 - protein, 23 aa, Homo sapiens
MALSFSLLMAVLVLSYKSICSLG

SEQ ID NO: 205849 - protein, 23 aa, Homo sapiens
MALPFALMMALVVLSCKSSCSLG

SEQ ID NO: 205850 - protein, 23 aa, Homo sapiens
MALSFSLLMAVLVLSYKSICSLG

SEQ ID NO: 205851 - protein, 23 aa, Homo sapiens
MALSFSLLMAVLVLSYKSICSLG

SEQ ID NO: 205852 - protein, 23 aa, Homo sapiens
MALTFALLVALLVLSCKSSCSVG

SEQ ID NO: 205853 - protein, 23 aa, Homo sapiens
MALSFSLLMAVLVLSYKSICSLG

SEQ ID NO: 205854 - protein, 23 aa, Homo sapiens
MALSFSLLMAVLVLSYKSICSLG

SEQ ID NO: 205855 - protein, 21 aa, Homo sapiens
MALPFVLLMALVVLNCKSICS

SEQ ID NO: 205856 - protein, 20 aa, Homo sapiens
MALPFALLMALVVLSCKSSC

SEQ ID NO: 205857 - protein, 23 aa, Homo sapiens
MARSFSLLMVVLVLSYKSICSLG

SEQ ID NO: 205858 - protein, 23 aa, Homo sapiens
MALTFYLLVALVVLSYKSFSSLG

SEQ ID NO: 205859 - protein, 21 aa, Homo sapiens
MTNKCLLQIALLLCFSTTALS

SEQ ID NO: 205860 - protein, 27 aa, Homo sapiens
MSTKPDMIQKCLWLEILMGIFIAGTLS

SEQ ID NO: 205861 - protein, 21 aa, Homo sapiens
MALLFPLLAALVMTSYSPVGS

SEQ ID NO: 205862 - protein, 26 aa, Homo sapiens
MLLSQNAFIFRSLNLVLMVYISLVFG

SEQ ID NO: 205863 - protein, 17 aa, Homo sapiens
MALLFLLPLVMQGVSRA

SEQ ID NO: 205864 - protein, 24 aa, Homo sapiens
MKASSLAFSLLSAAFYLLWTPSTG

SEQ ID NO: 205865 - protein, 25 aa, Homo sapiens
MEICRGLRSHLITLLLFLFHSETIC

SEQ ID NO: 205866 - protein, 17 aa, Homo sapiens
MKVLLRLICFIALLISS

SEQ ID NO: 205867 - protein, 18 aa, Homo sapiens
MGFWILAILTILMYSTAA

SEQ ID NO: 205868 - protein, 19 aa, Homo sapiens
MWSLLLCGLSIALPLSVTA

SEQ ID NO: 205869 - protein, 18 aa, Homo sapiens
MHSSALLCCLVLLTGVRA

SEQ ID NO: 205870 - protein, 21 aa, Homo sapiens
MLPCLVVLLAALLSLRLGSDA

SEQ ID NO: 205871 - protein, 19 aa, Homo sapiens
MAWSLGSWLGGCLLVSALG

SEQ ID NO: 205872 - protein, 22 aa, Homo sapiens
MCPARSLLLVATLVLLDHLSLA

SEQ ID NO: 205873 - protein, 22 aa, Homo sapiens
MCHQQLVISWFSLVFLASPLVA

SEQ ID NO: 205874 - protein, 32 aa, Homo sapiens
MGAARSPPSAVPGPLLGLLLLLLGVLAPGGAS

SEQ ID NO: 205875 - protein, 17 aa, Homo sapiens
MSLVLLSLAALCRSAVP

SEQ ID NO: 205876 - protein, 20 aa, Homo sapiens
MPVPWFLLSLALGRSPVVLS

SEQ ID NO: 205877 - protein, 23 aa, Homo sapiens
MTPGKTSLVSLLLLLSLEAIVKA

SEQ ID NO: 205878 - protein, 20 aa, Homo sapiens
MVKYLLLSILGLAFLSEAAA

SEQ ID NO: 205879 - protein, 18 aa, Homo sapiens
MNCRELPLTLWVLISVST

SEQ ID NO: 205880 - protein, 28 aa, Homo sapiens
MRHNWTPDLSPLWVLLLCAHVVTLLVRA

SEQ ID NO: 205881 - protein, 24 aa, Homo sapiens
MKLQCVSLWLLGTILILCSVDNHG

SEQ ID NO: 205882 - protein, 20 aa, Homo sapiens
MYRMQLLSCIALSLALVTNS

SEQ ID NO: 205883 - protein, 21 aa, Homo sapiens
MDSYLLMWGLLTFIMVPGCQA

SEQ ID NO: 205884 - protein, 26 aa, Homo sapiens
MAAPALSWRLPLLILLLPLATSWASA

SEQ ID NO: 205885 - protein, 29 aa, Homo sapiens
MQTFTMVLEEIWTSLFMWFFYALIPCLLT

SEQ ID NO: 205886 - protein, 19 aa, Homo sapiens
MPRGWAAPLLLLLLQGGWG

SEQ ID NO: 205887 - protein, 33 aa, Homo sapiens
MAALQKSVSSFLMGTLATSCLLLLALLVQGGAA

SEQ ID NO: 205888 - protein, 21 aa, Homo sapiens
MMPKHCFLGFLISFFLTGVAG

SEQ ID NO: 205889 - protein, 51 aa, Homo sapiens
MNFQQRLQSLWTLARPFCPPLLATASQMQMVVLPCLGFTLLLWSQVSGAQG

SEQ ID NO: 205890 - protein, 32 aa, Homo sapiens
MRERPRLGEDSSLISLFLQVVAFLAMVMGTHT

SEQ ID NO: 205891 - protein, 19 aa, Homo sapiens
MSRLPVLLLLQLLVRPGLQ

SEQ ID NO: 205892 - protein, 19 aa, Homo sapiens
MMWTWALWMLPSLCKFSLA

SEQ ID NO: 205893 - protein, 24 aa, Homo sapiens
MGLTSQLLPPLFFLLACAGNFVHG

SEQ ID NO: 205894 - protein, 19 aa, Homo sapiens
MRMLLHLSLLALGAAYVYA

SEQ ID NO: 205895 - protein, 20 aa, Homo sapiens
MIIVAHVLLILLGATEILQA

SEQ ID NO: 205896 - protein, 29 aa, Homo sapiens
MNSFSTSAFGPVAFSLGLLLVLPAAFPAP

SEQ ID NO: 205897 - protein, 19 aa, Homo sapiens
MLAVGCALLAALLAAPGAA

SEQ ID NO: 205898 - protein, 22 aa, Homo sapiens
MLTLQTWLVQALFIFLTTESTG

SEQ ID NO: 205899 - protein, 25 aa, Homo sapiens
MFHVSFRYIFGLPPLILVLLPVASS

SEQ ID NO: 205900 - protein, 20 aa, Homo sapiens
MTILGTTFGMVFSLLQVVSG

SEQ ID NO: 205901 - protein, 20 aa, Homo sapiens
MTSKLAVALLAAFLISAALC

SEQ ID NO: 205902 - protein, 18 aa, Homo sapiens
MLLAMVLTSALLLCSVAG

SEQ ID NO: 205903 - protein, 17 aa, Homo sapiens
MMREWVLLMSVLLCGLA

SEQ ID NO: 205904 - protein, 19 aa, Homo sapiens
MHSFPPLLLLLFWGVVSHS

SEQ ID NO: 205905 - protein, 19 aa, Homo sapiens
MQGPWVLLLLGLRLQLSLG

SEQ ID NO: 205906 - protein, 27 aa, Homo sapiens
MGTKAQVERKLLCLFILAILLCSLALG

SEQ ID NO: 205907 - protein, 28 aa, Homo sapiens
MARRSRHRLLLLLLRYLVVALGYHKAYG

SEQ ID NO: 205908 - protein, 31 aa, Homo sapiens
MALRRPPRLRLCARLPDFFLLLLFRGCLIGA

SEQ ID NO: 205909 - protein, 19 aa, Homo sapiens
MFCPLKLILLPVLLDYSLG

SEQ ID NO: 205910 - protein, 22 aa, Homo sapiens
MARSLLLPLQILLLSLALETAG

SEQ ID NO: 205911 - protein, 20 aa, Homo sapiens
MKSFLLVVNALALTLPFLAV

SEQ ID NO: 205912 - protein, 30 aa, Homo sapiens
MLPPPRPAAALALPVLLLLLVVLTPPPTGA

SEQ ID NO: 205913 - protein, 31 aa, Homo sapiens
MHKWILTWILPTLLYRSCFHIICLVGTISLA

SEQ ID NO: 205914 - protein, 21 aa, Homo sapiens
MSLLVVSMACVGFFLLQGAWP

SEQ ID NO: 205915 - protein, 20 aa, Homo sapiens
MLRMRVPALLVLLFCFRGRA

SEQ ID NO: 205916 - protein, 18 aa, Homo sapiens
MKLITILFLCSRLLLSLT

SEQ ID NO: 205917 - protein, 25 aa, Homo sapiens
MKKTQTWILTCIYLQLLLFNPLVKT

SEQ ID NO: 205918 - protein, 23 aa, Homo sapiens
MEWWASSPLRLWLLLFLLPSAQG

SEQ ID NO: 205919 - protein, 35 aa, Homo sapiens
MAPARTMARARLAPAGIPAVALWLLCTLGLQGTQA

SEQ ID NO: 205920 - protein, 27 aa, Homo sapiens
MAQLCGLRRSRAFLALLGSLLLSGVLA

SEQ ID NO: 205921 - protein, 23 aa, Homo sapiens
MPRPRLLAALCGALLCAPSLLVA

SEQ ID NO: 205922 - protein, 21 aa, Homo sapiens
MKPVWVATLLWMLLLVPRLGA

SEQ ID NO: 205923 - protein, 19 aa, Homo sapiens
MELSWHVVFIALLSFSCWG

SEQ ID NO: 205924 - protein, 19 aa, Homo sapiens
MKLVFLVLLFLGALGLCLA

SEQ ID NO: 205925 - protein, 21 aa, Homo sapiens
MGLLQLLAFSFLALCRARVRA

SEQ ID NO: 205926 - protein, 33 aa, Homo sapiens
MRGSHRAAPALRPRGRLWPVLAVLAAAAAAGCA

SEQ ID NO: 205927 - protein, 21 aa, Homo sapiens
MAPLALHLLVLVPILLSLVAS

SEQ ID NO: 205928 - protein, 21 aa, Homo sapiens
MICQKFCVVLLHWEFIYVITA

SEQ ID NO: 205929 - protein, 35 aa, Homo sapiens
MSSWSRQRPKSPGGIQPHVSRTLFLLLLLAASAWG

SEQ ID NO: 205930 - protein, 25 aa, Homo sapiens
MARMSFVIAACQLVLGLLMTSLTES

SEQ ID NO: 205931 - protein, 35 aa, Homo sapiens
MGLQTTKWPSHGAFFLKSWLIISLGLYSQVSKLLA

SEQ ID NO: 205932 - protein, 47 aa, Homo sapiens
MGSLQHCCCLLPKMGDTWAQLPWPGPPHPAMLLISLLLAAGLMHSDA

SEQ ID NO: 205933 - protein, 22 aa, Homo sapiens
MKVLAAGVVPLLLVLHWKHGAG

SEQ ID NO: 205934 - protein, 23 aa, Homo sapiens
MYLWLKLLAFGFAFLDTEVFVTG

SEQ ID NO: 205935 - protein, 23 aa, Homo sapiens
MTPILTVLICLGLSLDPRTHVQA

SEQ ID NO: 205936 - protein, 19 aa, Homo sapiens
MATLLLLLGVLVVSPDALG

SEQ ID NO: 205937 - protein, 18 aa, Homo sapiens
MKPLLLAVSLGLIAALQA

SEQ ID NO: 205938 - protein, 25 aa, Homo sapiens
MGALARALPSILLALLLTSTPEALG

SEQ ID NO: 205939 - protein, 27 aa, Homo sapiens
MESKALLVLTLAVWLQSLTASRGGVAA

SEQ ID NO: 205940 - protein, 22 aa, Homo sapiens
MAQTSSYFMLISCLMFLSQSQG

SEQ ID NO: 205941 - protein, 18 aa, Homo sapiens
MWLRAFILATLSASAAWG

SEQ ID NO: 205942 - protein, 33 aa, Homo sapiens
MTMETQMSQNVCPRNLWLLQPLTVLLLLASADS

SEQ ID NO: 205943 - protein, 21 aa, Homo sapiens
MGPWGWKLRWTVALLLAAAGT

SEQ ID NO: 205944 - protein, 28 aa, Homo sapiens
MIFPWKCQSTQRDLWNIFKLWGWTMLCC

SEQ ID NO: 205945 - protein, 18 aa, Homo sapiens
MSLSAFTLFLALIGGTSG

SEQ ID NO: 205946 - protein, 31 aa, Homo sapiens
MEPPDAPAQARGAPRLLLLAVLLAAHPDAQA

SEQ ID NO: 205947 - protein, 20 aa, Homo sapiens
MEMLQGLLLLLLLSMGGAWA

SEQ ID NO: 205948 - protein, 25 aa, Homo sapiens
MAMGVPRVILLCLFGAALCLTGSQA

SEQ ID NO: 205949 - protein, 22 aa, Homo sapiens
MEPGPALAWLLLLSLLADCLKA

SEQ ID NO: 205950 - protein, 21 aa, Homo sapiens
MASRWAVQLLLVAAWSMGCGE

SEQ ID NO: 205951 - protein, 28 aa, Homo sapiens
MWEAQFLGLLFLQPLWVAPVKPLQPGAE

SEQ ID NO: 205952 - protein, 20 aa, Homo sapiens
MRTALLLLAALAVATGPALT

SEQ ID NO: 205953 - protein, 27 aa, Homo sapiens
MRTGWATPRRPAGLLMLLFWFFDLAEP

SEQ ID NO: 205954 - protein, 20 aa, Homo sapiens
MKGFTATLFLWTLIFPSCSG

SEQ ID NO: 205955 - protein, 28 aa, Homo sapiens
MVAGSDAGRALGVLSVVCLLHCFGFISC

SEQ ID NO: 205956 - protein, 34 aa, Homo sapiens
MTPPERLFLPRVCGTTLHLLLLGLLLVLLPGAQG

SEQ ID NO: 205957 - protein, 32 aa, Homo sapiens
MITGVFSMRLWTPVGVLTSLAYCLHQRRVALA

SEQ ID NO: 205958 - protein, 30 aa, Homo sapiens
MAGKRSGWSRAALLQLLLGVNLVVMPPTRA

SEQ ID NO: 205959 - protein, 49 aa, Homo sapiens
MGAYARASGVCARGCLDSAGPWTMSRALRPPLPPLCFFLLLLAAAGARA

SEQ ID NO: 205960 - protein, 28 aa, Homo sapiens
MIRAAPPPLFLLLLLLLLLVSWASRGEA

SEQ ID NO: 205961 - protein, 27 aa, Homo sapiens
MAPRSARRPLLLLLPVAAARPHALSSA

SEQ ID NO: 205962 - protein, 28 aa, Homo sapiens
MVCFRLFPVPGSGLVLVCLVLGAVRSYA

SEQ ID NO: 205963 - protein, 18 aa, Homo sapiens
MKALIVLGLVLLSVTVQG

SEQ ID NO: 205964 - protein, 32 aa, Homo sapiens
MTAPGAAGRCPPTTWLGSLLLLVCLLASRSIT

SEQ ID NO: 205965 - protein, 34 aa, Homo sapiens; identical to SEQ ID NO: 205592

SEQ ID NO: 205966 - protein, 34 aa, Homo sapiens; identical to SEQ ID NO: 205593

SEQ ID NO: 205967 - protein, 22 aa, Homo sapiens
MGELMAFLLPLIIVLMVKHSDS

SEQ ID NO: 205968 - protein, 18 aa, Homo sapiens
MKLLMVLMLAALLLHCYA

SEQ ID NO: 205969 - protein, 20 aa, Homo sapiens
MSLFPSLPLLLLSMVAASYS

SEQ ID NO: 205970 - protein, 15 aa, Homo sapiens
MRLILPVGLIATTLA

SEQ ID NO: 205971 - protein, 17 aa, Homo sapiens
MRLTVLCAVCLLPGSLA

SEQ ID NO: 205972 - protein, 19 aa, Homo sapiens
MKSLILLAILAALAVVTLC

SEQ ID NO: 205973 - protein, 19 aa, Homo sapiens
MSLWQPLVLVLLVLGCCFA

SEQ ID NO: 205974 - protein, 24 aa, Homo sapiens
MDLVLKRCLLHLAVIGALLAVGAT

SEQ ID NO: 205975 - protein, 24 aa, Homo sapiens
MARSLVCLGVIILLSAFSGPGVRG

SEQ ID NO: 205976 - protein, 19 aa, Homo sapiens
MRGPSGALWLLLALRTVLG

SEQ ID NO: 205977 - protein, 34 aa, Homo sapiens
MEPPGRRECPFPSWRFPGLLLAAMVLLLYSFSDA

SEQ ID NO: 205978 - protein, 17 aa, Homo sapiens
MKLVNIWLLLLVVLLCG

SEQ ID NO: 205979 - protein, 36 aa, Homo sapiens
MALPTARPLLGSCGTPALGSLLFLLFSLGWVQPSRT

SEQ ID NO: 205980 - protein, 23 aa, Homo sapiens
MAPFEPLASGILLLLWLIAPSRA

SEQ ID NO: 205981 - protein, 26 aa, Homo sapiens
MGAAARTLRLALGLLLLATLLRPADA

SEQ ID NO: 205982 - protein, 23 aa, Homo sapiens
MTPWLGLIVLLGSWSLGDWGAEA

SEQ ID NO: 205983 - protein, 23 aa, Homo sapiens
MGLGPVFLLLAGIFPFAPPGAAA

SEQ ID NO: 205984 - protein, 21 aa, Homo sapiens
MKALLALPLLLLLSTPPCAPQ

SEQ ID NO: 205985 - protein, 20 aa, Homo sapiens
MQHRGFLLLTLLALLALTSA

SEQ ID NO: 205986 - protein, 20 aa, Homo sapiens
MKTLQSTLLLLLLVPLIKPA

SEQ ID NO: 205987 - protein, 19 aa, Homo sapiens
MERASCLLLLLLPLVHVSA

SEQ ID NO: 205988 - protein, 23 aa, Homo sapiens
MTPGTQSPFFLLLLLTVLTVVTG

SEQ ID NO: 205989 - protein, 20 aa, Homo sapiens
MKFLAVLVLLGVSIFLVSAQ

SEQ ID NO: 205990 - protein, 29 aa, Homo sapiens
MAPGAPSSSPSPILAVLLFSSLVLSPAQA

SEQ ID NO: 205991 - protein, 31 aa, Homo sapiens
MQQRGAAGSRGCALFPLLGVLFFQGVYIVFS

SEQ ID NO: 205992 - protein, 19 aa, Homo sapiens
MIFLTALPLFWIMISASRG

SEQ ID NO: 205993 - protein, 29 aa, Homo sapiens
MASLSRPSLPSCLCSFLLLLLLQVSSSYA

SEQ ID NO: 205994 - protein, 25 aa, Homo sapiens
MAHRPPSPALASVLLALLLSGAARA

SEQ ID NO: 205995 - protein, 48 aa, Homo sapiens
MGVPFFSSLRCMVDLGPCWAGGLTAEMKLLLALAGLLAILATPQPSEG

SEQ ID NO: 205996 - protein, 23 aa, Homo sapiens
MARKSNLPVLLVPFLLCQALVRC

SEQ ID NO: 205997 - protein, 26 aa, Homo sapiens
MAAVVAATRWWQLLLVLSAAGMGASG

SEQ ID NO: 205998 - protein, 36 aa, Homo sapiens
MRLLPLAPGRLRRGSPRHLPSCSPALLLLVLGGCLG

SEQ ID NO: 205999 - protein, 21 aa, Homo sapiens
MAQGVLWILLGLLLWSDPGTA

SEQ ID NO: 206000 - protein, 26 aa, Homo sapiens
MDPQTAPSRALLLLLFLHLAFLGGRS

SEQ ID NO: 206001 - protein, 21 aa, Homo sapiens
MLGQVVTLILLLLLKVYQGKG

SEQ ID NO: 206002 - protein, 19 aa, Homo sapiens
MAGPSLACCLLGLLALTSA

SEQ ID NO: 206003 - protein, 19 aa, Homo sapiens
MVVALRYVWPLLLCSPCLL

SEQ ID NO: 206004 - protein, 22 aa, Homo sapiens
MQLTRCCFVFLVQGSLYLVICG

SEQ ID NO: 206005 - protein, 15 aa, Homo sapiens
MLRVLVGAVLPAMLL

SEQ ID NO: 206006 - protein, 26 aa, Homo sapiens
MVSRMVSTMLSGLLFWLASGWTPAFA

SEQ ID NO: 206007 - protein, 41 aa, Homo sapiens
MSRPQGLLWLPLLFTPVCVMLNSNVLLWLTALAIKFTLIDS

SEQ ID NO: 206008 - protein, 24 aa, Homo sapiens
MARRAGGARMFGSLLLFALLAAGV

SEQ ID NO: 206009 - protein, 22 aa, Homo sapiens
MALERLCSVLKVLLITVLVVEG

SEQ ID NO: 206010 - protein, 21 aa, Homo sapiens
MERGLPLLCAVLALVLAPAGA

SEQ ID NO: 206011 - protein, 28 aa, Homo sapiens
MSGSSLPSALALSLLLVSGSLLPGPGAA

SEQ ID NO: 206012 - protein, 33 aa, Homo sapiens
MGVCGYLFLPWKCLVVVSLRLLFLVPTGVPVRS

SEQ ID NO: 206013 - protein, 20 aa, Homo sapiens
MFSLKTLPFLLLLHVQISKA

SEQ ID NO: 206014 - protein, 19 aa, Homo sapiens
MRTLAILAAILLVALQAQA

SEQ ID NO: 206015 - protein, 19 aa, Homo sapiens
MRTLAILAAILLVALQAQA

SEQ ID NO: 206016 - protein, 20 aa, Homo sapiens
MPLGLLWLGLALLGALHAQA

SEQ ID NO: 206017 - protein, 28 aa, Homo sapiens
MLASSSRIRAAWTRALLLPLLLAGPVGC

SEQ ID NO: 206018 - protein, 30 aa, Homo sapiens
MEGDRVAGRPVLSSLPVLLLLQLLMLRAAA

SEQ ID NO: 206019 - protein, 25 aa, Homo sapiens
MAAAAATKILLCLPLLLLLSGWSRA

SEQ ID NO: 206020 - protein, 34 aa, Homo sapiens
MESPSAPPHRWCIPWQRLLLTASLLTFWNPPTTA

SEQ ID NO: 206021 - protein, 27 aa, Homo sapiens
MVPKLFTSQICLLLLLGLLAVEGSLHV

SEQ ID NO: 206022 - protein, 20 aa, Homo sapiens
MSCPVPACCALLLVLGLCRA

SEQ ID NO: 206023 - protein, 30 aa, Homo sapiens
DVSLCPAKCSFWRIFLLGSVWLDYVGSVLA

SEQ ID NO: 206024 - protein, 29 aa, Homo sapiens
MRAPGRPALRPLPLPPLLLLLLAAPWGRA

SEQ ID NO: 206025 - protein, 28 aa, Homo sapiens
MMVALRGASALLVLFLAAFLPPPQCTQD

SEQ ID NO: 206026 - protein, 24 aa, Homo sapiens
MEYQILKMSLCLFILLFLTPGILC

SEQ ID NO: 206027 - protein, 25 aa, Homo sapiens
MGVLLTQRTLLSLVLALLFPSMASM

SEQ ID NO: 206028 - protein, 17 aa, Homo sapiens
MARILLLFLPGLVAVCA

SEQ ID NO: 206029 - protein, 15 aa, Homo sapiens
MKFFLLLFTIGFCWA

SEQ ID NO: 206030 - protein, 29 aa, Homo sapiens
MAAARLCLSLLLLSTCVALLLQPLLGAQG

SEQ ID NO: 206031 - protein, 23 aa, Homo sapiens
MKVTGIFLLSALALLSLSGNTGA

SEQ ID NO: 206032 - protein, 16 aa, Homo sapiens
MLPLWTLSLLLGAVAG

SEQ ID NO: 206033 - protein, 25 aa, Homo sapiens
MIPAKDMAKVMIVMLAICFLTKSDG

SEQ ID NO: 206034 - protein, 15 aa, Homo sapiens
MKWLLLLGLVALSEC

SEQ ID NO: 206035 - protein, 27 aa, Homo sapiens
MHGSCSFLMLLLPLLLLLVATTGPVGA

SEQ ID NO: 206036 - protein, 20 aa, Homo sapiens
MGLPGLFCLAVLAASSFSKA

SEQ ID NO: 206037 - protein, 28 aa, Homo sapiens
MVFVRRPWPALTTVLLALLVCLGALVDA

SEQ ID NO: 206038 - protein, 25 aa, Homo sapiens
MKVLLAAALIAGSVFFLLLPGPSAA

SEQ ID NO: 206039 - protein, 21 aa, Homo sapiens
MAARLLLLGILLLLLPLPVPA

SEQ ID NO: 206040 - protein, 24 aa, Homo sapiens
MGPPGSPWQWVTLLLGLLLPPAAP

SEQ ID NO: 206041 - protein, 22 aa, Homo sapiens
MGWTMRLVTAALLLGLMMVVTG

SEQ ID NO: 206042 - protein, 23 aa, Homo sapiens
MSAFRLWPGLLIMLGSLCHRGSP

SEQ ID NO: 206043 - protein, 21 aa, Homo sapiens
MLLAWVQAFLVSNMLLAEAYG

SEQ ID NO: 206044 - protein, 15 aa, Homo sapiens
MKLLVLAVLLTVAAA

SEQ ID NO: 206045 - protein, 20 aa, Homo sapiens
MKTLLLLAVIMIFGLLQAHG

SEQ ID NO: 206046 - protein, 17 aa, Homo sapiens
MALFGALFLALLAGAHA

SEQ ID NO: 206047 - protein, 18 aa, Homo sapiens
MPVMRLFPCFLQLLAGLA

SEQ ID NO: 206048 - protein, 18 aa, Homo sapiens
MRACISLVLAVLCGLAWA

SEQ ID NO: 206049 - protein, 19 aa, Homo sapiens
MILFKQATYFISLFATVSC

SEQ ID NO: 206050 - protein, 22 aa, Homo sapiens
MASRLTLLTLLLLLLAGDRASS

SEQ ID NO: 206051 - protein, 19 aa, Homo sapiens
MQLFLLLCLVLLSPQGASL

SEQ ID NO: 206052 - protein, 19 aa, Homo sapiens
MEHKEVVLLLLLFLKSGQG

SEQ ID NO: 206053 - protein, 23 aa, Homo sapiens
MQMSPALTCLVLGLALVFGEGSA

SEQ ID NO: 206054 - protein, 34 aa, Homo sapiens
MSLRLDTTPSCNSARPLHALQVLLLLSLLLTALA

SEQ ID NO: 206055 - protein, 27 aa, Homo sapiens
MQPRWAQGATMWLGVLLTLLLCSSLEG

SEQ ID NO: 206056 - protein, 31 aa, Homo sapiens
MSSAAGFCASRPGLLFLGLLLLPLVVAFASA

SEQ ID NO: 206057 - protein, 30 aa, Homo sapiens
MSSAARSRLTRATRQEMLFLALLLLPVVVA

SEQ ID NO: 206058 - protein, 16 aa, Homo sapiens
MPLLLLLLLLPSPLHP

SEQ ID NO: 206059 - protein, 26 aa, Homo sapiens
MGSGPRGALSLLLLLLAPPSRPAAGC

SEQ ID NO: 206060 - protein, 16 aa, Homo sapiens
MPAWGALFLLWATAEA

SEQ ID NO: 206061 - protein, 32 aa, Homo sapiens
MGVPTALEAGSWRWGSLLFALFLAASLGPVAA

SEQ ID NO: 206062 - protein, 21 aa, Homo sapiens
MVPPKLHVLFCLCGCLAVVYP

SEQ ID NO: 206063 - protein, 20 aa, Homo sapiens
MRTLACLLLLGCGYLAHVLA

SEQ ID NO: 206064 - protein, 20 aa, Homo sapiens
MNRCWALFLSLCCYLRLVSA

SEQ ID NO: 206065 - protein, 32 aa, Homo sapiens
MQAQQYQQQRRKFAAAFLAFIFILAAVDTAEA

SEQ ID NO: 206066 - protein, 18 aa, Homo sapiens
MLLFVLTCLLAVFPAIST

SEQ ID NO: 206067 - protein, 26 aa, Homo sapiens
MGLGARGAWAALLLGTLQVLALLGAA

SEQ ID NO: 206068 - protein, 25 aa, Homo sapiens
MRKDRLLHLCLVLLLILLSASDSNS

SEQ ID NO: 206069 - protein, 34 aa, Homo sapiens
MGTLSAPPCTQRIKWKGLLLTASLLNFWNLPTTA

SEQ ID NO: 206070 - protein, 34 aa, Homo sapiens
MGPLSAPPCTEHIKWKGLLVTASLLNFWNLPTTA

SEQ ID NO: 206071 - protein, 22 aa, Homo sapiens
MARAPPLLAALTALLAAAAAGG

SEQ ID NO: 206072 - protein, 16 aa, Homo sapiens
MYALFLLASLLGAALA

SEQ ID NO: 206073 - protein, 20 aa, Homo sapiens
MATPRGLGALLLLLLLPTSG

SEQ ID NO: 206074 - protein, 23 aa, Homo sapiens
MRGANAWAPLCLLLAAATQLSRQ

SEQ ID NO: 206075 - protein, 23 aa, Homo sapiens
MKPIQKLLAGLILLTWCVEGCSS

SEQ ID NO: 206076 - protein, 19 aa, Homo sapiens
MIFLLLMLSLELQLHQIAA

SEQ ID NO: 206077 - protein, 19 aa, Homo sapiens
MRGATRVSIMLLLVTVSDC

SEQ ID NO: 206078 - protein, 27 aa, Homo sapiens
MRSLCCAPLLLLLLLPPLLLTPRAGDA

SEQ ID NO: 206079 - protein, 28 aa, Homo sapiens
MNIKGSPWKGSLLLLLVSNLLLCQSVAP

SEQ ID NO: 206080 - protein, 24 aa, Homo sapiens
MKENVASATVFTLLLFLNTCLLNG

SEQ ID NO: 206081 - protein, 28 aa, Homo sapiens
MRLLQLLFRASPATLLLVLCLQLGANKA

SEQ ID NO: 206082 - protein, 27 aa, Homo sapiens
MASSPWGCVCGLLLLLLPLLGTGPALG

SEQ ID NO: 206083 - protein, 17 aa, Homo sapiens
MIWYILIIGILLPQSLA

SEQ ID NO: 206084 - protein, 25 aa, Homo sapiens
MVSRKAVAALLVVHVAAMLASQTEA

SEQ ID NO: 206085 - protein, 28 aa, Homo sapiens
MLGNKRLGLSGLTLALSLLVCLGALAEA

SEQ ID NO: 206086 - protein, 27 aa, Homo sapiens
MITEGAQAPRLLLPPLLLLLTLPATGS

SEQ ID NO: 206087 - protein, 30 aa, Homo sapiens
MGTVSSRRSWWPLPLLLLLLLLLGPAGARA

SEQ ID NO: 206088 - protein, 24 aa, Homo sapiens
MPRLFFFHLLGVCLLLNQFSRAVA

SEQ ID NO: 206089 - protein, 23 aa, Homo sapiens
MSRSLLLRFLLFLLLLPPLPVLL

SEQ ID NO: 206090 - protein, 22 aa, Homo sapiens
MATHHTLWMGLALLGVLGDLQA

SEQ ID NO: 206091 - protein, 20 aa, Homo sapiens
MKAVLLALLMAGLALQPGTA

SEQ ID NO: 206092 - protein, 17 aa, Homo sapiens
MWVPVVFLTLSVTWIGA

SEQ ID NO: 206093 - protein, 32 aa, Homo sapiens
MRAAPLLLARAASLSLGFLFLLFFWLDRSVLA

SEQ ID NO: 206094 - protein, 19 aa, Homo sapiens
MRSLGALLLLLSACLAVSA

SEQ ID NO: 206095 - protein, 21 aa, Homo sapiens
MWATQGLAVALALSVLPGSRA

SEQ ID NO: 206096 - protein, 31 aa, Homo sapiens
MAGLSRGSARALLAALLASTLLALLVSPARG

SEQ ID NO: 206097 - protein, 17 aa, Homo sapiens
MLRRALLCLAVAALVRA

SEQ ID NO: 206098 - protein, 24 aa, Homo sapiens
MRLRRLALFPGVALLLAAARLAAA

SEQ ID NO: 206099 - protein, 30 aa, Homo sapiens
MAGSRQRGLRARVRPLFCALLLSLGRFVRG

SEQ ID NO: 206100 - protein, 17 aa, Homo sapiens
MAVFLQLLPLLLSRAQG

SEQ ID NO: 206101 - protein, 21 aa, Homo sapiens
MESRVLLRTFCLIFGLGAVWG

SEQ ID NO: 206102 - protein, 31 aa, Homo sapiens
MQSVQSTSFCLRKQCLCLTFLLLHLLGQVAA

SEQ ID NO: 206103 - protein, 20 aa, Homo sapiens
MVYKTLFALCILTAGWRVQS

SEQ ID NO: 206104 - protein, 21 aa, Homo sapiens
MKVVPSLLLSVLLAQVWLVPG

SEQ ID NO: 206105 - protein, 22 aa, Homo sapiens
MASSIRRGRGAWTRLLSLLLLA

SEQ ID NO: 206106 - protein, 26 aa, Homo sapiens
MAVRELCFPRQRQVLFLFLFWGVSLA

SEQ ID NO: 206107 - protein, 41 aa, Homo sapiens
MANCQIAILYQRFQRVVFGISQLLCFSALISELTNQKEVAA

SEQ ID NO: 206108 - protein, 20 aa, Homo sapiens
MWLCPLALNLILMAASGAVC

SEQ ID NO: 206109 - protein, 20 aa, Homo sapiens
MWLCPLALNLILMAASGAAC

SEQ ID NO: 206110 - protein, 41 aa, Homo sapiens
MVGQMYCYPGSHLARALTRALALALVLALLVGPFLSGLAGA

SEQ ID NO: 206111 - protein, 19 aa, Homo sapiens
MRRLLEPCWWILFLKITSS

SEQ ID NO: 206112 - protein, 26 aa, Homo sapiens
MLPPMALPSVSWMLLSCLILLCQVQG

SEQ ID NO: 206113 - protein, 22 aa, Homo sapiens
MASRSMRLLLLLSCLAKTGVLG

SEQ ID NO: 206114 - protein, 25 aa, Homo sapiens
MARYMLLLLLAVWVLTGELWPGAEA

SEQ ID NO: 206115 - protein, 23 aa, Homo sapiens
MDGWRRMPRWGLLLLLWGSCTFG

SEQ ID NO: 206116 - protein, 26 aa, Homo sapiens
MELALRRSPVPRWLLLLPLLLGLNAG

SEQ ID NO: 206117 - protein, 17 aa, Homo sapiens
MMREWVLLMSVLLCGLA

SEQ ID NO: 206118 - protein, 18 aa, Homo sapiens
MKWVWALLLLAALGSGRA

SEQ ID NO: 206119 - protein, 28 aa, Homo sapiens
MALQRTHSLLLLLLLTLLGLGLVQPSYG

SEQ ID NO: 206120 - protein, 28 aa, Homo sapiens
MALEKSLVRLLLLVLILLVLGWVQPSLG

SEQ ID NO: 206121 - protein, 23 aa, Homo sapiens
MEAPAAGLFLLLLLGTWAPAPGS

SEQ ID NO: 206122 - protein, 18 aa, Homo sapiens
MRPLLLLALLGWLLLAEA

SEQ ID NO: 206123 - protein, 16 aa, Homo sapiens
MLLILLSVALLAFSSA

SEQ ID NO: 206124 - protein, 28 aa, Homo sapiens
MGHHRPWLHASVLWAGVASLLLPPAMTQ

SEQ ID NO: 206125 - protein, 40 aa, Homo sapiens
MMLPQNSWHIDFGRCCCHQNLFSAVVTCILLLNSCFLISS

SEQ ID NO: 206126 - protein, 23 aa, Homo sapiens
MQLPLALCLVCLLVHTAFRVVEG

SEQ ID NO: 206127 - protein, 23 aa, Homo sapiens
MLPPAIHFYLLPLACILMKSCLA

SEQ ID NO: 206128 - protein, 20 aa, Homo sapiens
MKLMVLVFTIGLTLLLGVQA

SEQ ID NO: 206129 - protein, 31 aa, Homo sapiens
MGIGRSEGGRRGAALGVLLALGAALLAVGSA

SEQ ID NO: 206130 - protein, 24 aa, Homo sapiens
MLQGPGSLLLLFLASHCCLGSARG

SEQ ID NO: 206131 - protein, 32 aa, Homo sapiens
MVCGSPGGMLLLRAGLLALAALCLLRVPGARA

SEQ ID NO: 206132 - protein, 21 aa, Homo sapiens
MRLSVCLLMVSLALCCYQAHA

SEQ ID NO: 206133 - protein, 20 aa, Homo sapiens
MQPTLLLSLLGAVGLAAVNS

SEQ ID NO: 206134 - protein, 19 aa, Homo sapiens
MWRSLGLALALCLLPSGGT

SEQ ID NO: 206135 - protein, 38 aa, Homo sapiens
MGLRSWLAAPWGALPPRPPLLLLLLLLLLLQPPPPTWA

SEQ ID NO: 206136 - protein, 25 aa, Homo sapiens
MQTPRASPPRPALLLLLLLLGGAHG

SEQ ID NO: 206137 - protein, 23 aa, Homo sapiens
MKPNIIFVLSLLLILEKQAAVMG

SEQ ID NO: 206138 - protein, 23 aa, Homo sapiens
MKSIILFVLSLLLILEKQAAVMG

SEQ ID NO: 206139 - protein, 27 aa, Homo sapiens
MMQKLLKCSRLVLALALILVLESSVQG

SEQ ID NO: 206140 - protein, 23 aa, Homo sapiens
MALSVLRLALLLLAVTFAASLIP

SEQ ID NO: 206141 - protein, 23 aa, Homo sapiens
MKLSGMFLLLSLALFCFLTGVFS

SEQ ID NO: 206142 - protein, 19 aa, Homo sapiens
MRLAVGALLVCAVLGLCLA

SEQ ID NO: 206143 - protein, 18 aa, Homo sapiens
MKWVTFISLLFLFSSAYS

SEQ ID NO: 206144 - protein, 18 aa, Homo sapiens
MKLLTGLVFCSLVLGVSS

SEQ ID NO: 206145 - protein, 18 aa, Homo sapiens
MRLFTGIVFCSLVMGVTS

SEQ ID NO: 206146 - protein, 19 aa, Homo sapiens
MNKPLLWISVLTSLLEAFA

SEQ ID NO: 206147 - protein, 29 aa, Homo sapiens
MESRGPLATSRLLLLLLLLLLRHTRQGWA

SEQ ID NO: 206148 - protein, 47 aa, Homo sapiens
MTGERPSTALPDRRWGPRILGFWGGCRVWVFAAIFLLLSLAASWSKA

SEQ ID NO: 206149 - protein, 18 aa, Homo sapiens
MFALGLPFLVLLVASVES

SEQ ID NO: 206150 - protein, 21 aa, Homo sapiens
MAQHHLWILLLCLQTWPEAAG

SEQ ID NO: 206151 - protein, 21 aa, Homo sapiens
MLWLFQSLLFVFCFGPGNVVS

SEQ ID NO: 206152 - protein, 22 aa, Homo sapiens
MAGSPTCLTLIYILWQLTGSAA

SEQ ID NO: 206153 - protein, 22 aa, Homo sapiens
MVMRPLWSLLLWEALLPITVTG

SEQ ID NO: 206154 - protein, 24 aa, Homo sapiens
MLSCRLQCALAALSIVLALGCVTG

SEQ ID NO: 206155 - protein, 26 aa, Homo sapiens
MATGSRTSLLLAFGLLCLPWLQEGSA

SEQ ID NO: 206156 - protein, 17 aa, Homo sapiens
MRAWIFFLLCLAGRALA

SEQ ID NO: 206157 - protein, 46 aa, Homo sapiens
MPRYGASLRQSCPRSGREQGQDGTAGAPGLLWMGLVLALALALALA

SEQ ID NO: 206158 - protein, 17 aa, Homo sapiens
MLQNSAVLLVLVISASA

SEQ ID NO: 206159 - protein, 19 aa, Homo sapiens
MKFLVFAFILALMVSMIGA

SEQ ID NO: 206160 - protein, 21 aa, Homo sapiens
MPLRKMKIPFLLLFFLWEAES

SEQ ID NO: 206161 - protein, 14 aa, Homo sapiens
MLVLGLLVAGAADG

SEQ ID NO: 206162 - protein, 22 aa, Homo sapiens
MKSLTWILGLWALAACFTPGES

SEQ ID NO: 206163 - protein, 33 aa, Homo sapiens
MAAPALGLVCGRCPELGLVLLLLLLSLLCGAAG

SEQ ID NO: 206164 - protein, 19 aa, Homo sapiens
MGSGLPLVLLLTLLGSSHG

SEQ ID NO: 206165 - protein, 20 aa, Homo sapiens
MKSLSLLLAVALGLATAVSA

SEQ ID NO: 206166 - protein, 18 aa, Homo sapiens
MGTQEGWCLLLCLALSGA

SEQ ID NO: 206167 - protein, 21 aa, Homo sapiens
MDMWTALLILQALLLPSLADG

SEQ ID NO: 206168 - protein, 25 aa, Homo sapiens
MAGPPRLLLLPLLLALARGLPGALA

SEQ ID NO: 206169 - protein, 27 aa, Homo sapiens
MAMLLGASVLILWLQPDWVNSQQKNDD

SEQ ID NO: 206170 - protein, 20 aa, Homo sapiens
IFASLLRAVIASICVVSSMA

SEQ ID NO: 206171 - protein, 20 aa, Homo sapiens
MLLLLVPVLEVIFTLGGTRA

SEQ ID NO: 206172 - protein, 21 aa, Homo sapiens
MGTSLLCWMALCLLGADHADT

SEQ ID NO: 206173 - protein, 20 aa, Homo sapiens
MRWALLVLLAFLSPASQKSS

SEQ ID NO: 206174 - protein, 24 aa, Homo sapiens
MSFPCKFVASFLLIFNVSSKGAVS

SEQ ID NO: 206175 - protein, 16 aa, Homo sapiens
MLFLLLPLLAVLPGDG

SEQ ID NO: 206176 - protein, 19 aa, Homo sapiens
MLLLFLLFEGLCCPGENTA

SEQ ID NO: 206177 - protein, 21 aa, Homo sapiens
MEHSTFLSGLVLATLLSQVSP

SEQ ID NO: 206178 - protein, 22 aa, Homo sapiens
MQSGTHWRVLGLCLLSVGVWGQ

SEQ ID NO: 206179 - protein, 22 aa, Homo sapiens
MEQGKGLAVLILAIILLQGTLA

SEQ ID NO: 206180 - protein, 21 aa, Homo sapiens
MKWKALFTAAILQAQLPITEA

SEQ ID NO: 206181 - protein, 25 aa, Homo sapiens
MNRGVPFRHLLLVLQLALLPAATQG

SEQ ID NO: 206182 - protein, 24 aa, Homo sapiens
MPMGSLQPLATLYLLGMLVASCLG

SEQ ID NO: 206183 - protein, 21 aa, Homo sapiens
MALPVTALLLPLALLLHAARP

SEQ ID NO: 206184 - protein, 21 aa, Homo sapiens
MRPRLWLLLAAQLTVLHGNSV

SEQ ID NO: 206185 - protein, 18 aa, Homo sapiens
MLRLLLALNLFPSIQVTG

SEQ ID NO: 206186 - protein, 22 aa, Homo sapiens
MGAMTQLLAGVFLAFLALATEG

SEQ ID NO: 206187 - protein, 30 aa, Homo sapiens
MDCRKMARFSYSVIWIMAISKVFELGLVAG

SEQ ID NO: 206188 - protein, 22 aa, Homo sapiens
MRAPGCGRLVLPLLLLAAAALA

SEQ ID NO: 206189 - protein, 21 aa, Homo sapiens
MELWGAYLLLCLFSLLTQVTT

SEQ ID NO: 206190 - protein, 22 aa, Homo sapiens
MGRGLLRGLWPLHIVLWTRIAS

SEQ ID NO: 206191 - protein, 26 aa, Homo sapiens
METRPRLGATCLLGFSFLLLVISSDG

SEQ ID NO: 206192 - protein, 29 aa, Homo sapiens
MHPAVFLSLPDLRCSLLLLVTWVFTPVTT

SEQ ID NO: 206193 - protein, 18 aa, Homo sapiens
MLGVLVLGALALAGLGFP

SEQ ID NO: 206194 - protein, 21 aa, Homo sapiens
MELTELLLVVMLLLTARLTLS

SEQ ID NO: 206195 - protein, 18 aa, Homo sapiens
MGLAWGLGVLFLMHVCGT

SEQ ID NO: 206196 - protein, 19 aa, Homo sapiens
MNLAISIALLLTVLQVSRG

SEQ ID NO: 206197 - protein, 19 aa, Homo sapiens
MALVLEIFTLLASICWVSA

SEQ ID NO: 206198 - protein, 20 aa, Homo sapiens
MRPADLLQLVLLLDLPRDLG

SEQ ID NO: 206199 - protein, 20 aa, Homo sapiens
MTALFLMSMLFGLACGQAMS

SEQ ID NO: 206200 - protein, 20 aa, Homo sapiens
MSPFLYLVLLVLGLHATIHC

SEQ ID NO: 206201 - protein, 32 aa, Homo sapiens
METPAWPRVPRPETAVARTLLLGWVFAQVAGA

SEQ ID NO: 206202 - protein, 28 aa, Homo sapiens
MIYTMKKVHALWASVCLLLNLAPAPLNA

SEQ ID NO: 206203 - protein, 22 aa, Homo sapiens
MDPARPLGLSILLLFLTEAALG

SEQ ID NO: 206204 - protein, 22 aa, Homo sapiens
MDAMKRGLCCVLLLCGAVFVSP

SEQ ID NO: 206205 - protein, 34 aa, Homo sapiens
MGHTRRQGTSPSKCPYLNFFQLLVLAGLSHFCSG

SEQ ID NO: 206206 - protein, 37 aa, Homo sapiens
MAAAWPSGPSAPEAVTARLVGVLWFVSVTTGPWGAVA

SEQ ID NO: 206207 - protein, 24 aa, Homo sapiens
MTSIFHFAIIFMLILQIRIQLSEE

SEQ ID NO: 206208 - protein, 23 aa, Homo sapiens
MRQTLPCIYFWGGLLPFGMLCAS

SEQ ID NO: 206209 - protein, 23 aa, Homo sapiens
MMSASRLAGTLIPAMAFLSCVRP

SEQ ID NO: 206210 - protein, 20 aa, Homo sapiens
MGDHLDLLLGVVLMAGPVFG

SEQ ID NO: 206211 - protein, 40 aa, Homo sapiens
MVLWESPRQCSSWTLCEGFCWLLLLPVMLLIVARPVKLAA

SEQ ID NO: 206212 - protein, 23 aa, Homo sapiens
MRQSHQLPLVGLLLFSFIPSQLC

SEQ ID NO: 206213 - protein, 18 aa, Homo sapiens
MRHLGAFLFLLGVLGALT

SEQ ID NO: 206214 - protein, 29 aa, Homo sapiens
MPPSGLRLLLLLLPLLWLLVLTPGRPAAG

SEQ ID NO: 206215 - protein, 18 aa, Homo sapiens
MRLLPRLLLLLLLVFPAT

SEQ ID NO: 206216 - protein, 22 aa, Homo sapiens
MGSPGMVLGLLVQIWALQEASS

SEQ ID NO: 206217 - protein, 26 aa, Homo sapiens
MALPPGPAALRHTLLLLPALLSSGWG

SEQ ID NO: 206218 - protein, 33 aa, Homo sapiens
MWGARRSSVSSSWNAASLLQLLLAALLAAGARA

SEQ ID NO: 206219 - protein, 30 aa, Homo sapiens
MAAACGPGAAGYCLLLGLHLFLLTAGPALG

SEQ ID NO: 206220 - protein, 33 aa, Homo sapiens
MATLWGGLLRLGSLLSLSCLALSVLLLAQLSDA

SEQ ID NO: 206221 - protein, 20 aa, Homo sapiens
MASHRLLLLCLAGLVFVSEA

SEQ ID NO: 206222 - protein, 24 aa, Homo sapiens
MATMENKVICALVLVSMLALGTLA

SEQ ID NO: 206223 - protein, 21 aa, Homo sapiens
MAARALCMLGLVLALLSSSSA

SEQ ID NO: 206224 - protein, 19 aa, Homo sapiens
MGLQACLLGLFALILSGKC

SEQ ID NO: 206225 - protein, 15 aa, Homo sapiens
MNPLLILTFVAAALA

SEQ ID NO: 206226 - protein, 15 aa, Homo sapiens
MNLLLILTFVAAAVA

SEQ ID NO: 206227 - protein, 21 aa, Homo sapiens
MWRCPLGLLLLLPLAGHLALG

SEQ ID NO: 206228 - protein, 55 aa, Homo sapiens
MEQRGQNAPAASGARKRHGPGPREARGARPGPRVPKTLVLVVAAVLLLVSAESAL

SEQ ID NO: 206229 - protein, 23 aa, Homo sapiens
MARIPKTLKFVVVIVAVLLPVLA

SEQ ID NO: 206230 - protein, 55 aa, Homo sapiens
MGLWGQSVPTASSARAGRYPGARTASGTRPWLLDPKILKFVVFIVAVLLPVRVDS

SEQ ID NO: 206231 - protein, 21 aa, Homo sapiens
MNKLLCCALVFLDISIKWTTQ

SEQ ID NO: 206232 - protein, 38 aa, Homo sapiens
MEPPGDWGPPPWRSTPKTDVLRLVLYLTFLGAPCYAPA

SEQ ID NO: 206233 - protein, 28 aa, Homo sapiens
MGAGATGRAMDGPRLLLLLLLGVSLGGA

SEQ ID NO: 206234 - protein, 25 aa, Homo sapiens
MAQHGAMGAFRALCGLALLCALSLG

SEQ ID NO: 206235 - protein, 29 aa, Homo sapiens
MALKVLLEQEKTFFTLLVLLGYLSCKVTC

SEQ ID NO: 206236 - protein, 25 aa, Homo sapiens
MKPSLLCRPLSCFLMLLPWPLATLT

SEQ ID NO: 206237 - protein, 21 aa, Homo sapiens
MGLSTVPDLLLPLVLLELLVG

SEQ ID NO: 206238 - protein, 22 aa, Homo sapiens
MAPVAVWAALAVGLELWAAAHA

SEQ ID NO: 206239 - protein, 20 aa, Homo sapiens
MVRLPLQCVLWGCLLTAVHP

SEQ ID NO: 206240 - protein, 29 aa, Homo sapiens
MRALEGPGLSLLCLVLALPALLPVPAVRG

SEQ ID NO: 206241 - protein, 18 aa, Homo sapiens
MRVLLAALGLLFLGALRA

SEQ ID NO: 206242 - protein, 23 aa, Homo sapiens
MGNSCYNIVATLLLVLNFERTRS

SEQ ID NO: 206243 - protein, 26 aa, Homo sapiens
MAHVGDCTQTPWLPVLVVSLMCSARA

SEQ ID NO: 206244 - protein, 17 aa, Homo sapiens
MIILIYLFLLLWEDTQG

SEQ ID NO: 206245 - protein, 21 aa, Homo sapiens
MVWRVPPFLLPILFLASHVGA

SEQ ID NO: 206246 - protein, 23 aa, Homo sapiens
MDSLRKMLISVAMLGAGAGVGYA

SEQ ID NO: 206247 - protein, 20 aa, Homo sapiens
MGLPGLFCLAVLAASSFSKA

SEQ ID NO: 206248 - protein, 23 aa, Homo sapiens
MDSLRKMLISVAMLGAGAGVGYA

SEQ ID NO: 206249 - protein, 22 aa, Homo sapiens
MGHPPLLPLLLLLHTCVPASWG

SEQ ID NO: 206250 - protein, 20 aa, Homo sapiens
MRALLARLLLCVLVVSDSKG

SEQ ID NO: 206251 - protein, 24 aa, Homo sapiens
MGQPSLTWMLMVVVASWFITTAAT

SEQ ID NO: 206252 - protein, 20 aa, Homo sapiens
MYKLASCCLLFIGFLNPLLS

SEQ ID NO: 206253 - protein, 21 aa, Homo sapiens
MKLAVTLTLVTLALCCSSASA

SEQ ID NO: 206254 - protein, 37 aa, Homo sapiens
MVAVLGGRGVLRLRLLLSALKPGIHVPRAGPAAAFGT

SEQ ID NO: 206255 - protein, 24 aa, Homo sapiens
MPGKMVVILGASNILWIMFAASQA

SEQ ID NO: 206256 - protein, 26 aa, Homo sapiens
MNFLLSWVHWSLALLLYLHHAKWSQA

SEQ ID NO: 206257 - protein, 31 aa, Homo sapiens
MHLLGFFSVACSLLAAALLPGPREAPAAAAA

SEQ ID NO: 206258 - protein, 26 aa, Homo sapiens
MVSYWDTGVLLCALLSCLLLTGSSSG

SEQ ID NO: 206259 - protein, 24 aa, Homo sapiens
MQRGAALCLRLWLCLGLLDGLVSG

SEQ ID NO: 206260 - protein, 19 aa, Homo sapiens
MPDTMLPACFLGLLAFSSA

SEQ ID NO: 206261 - protein, 21 aa, Homo sapiens
MKVLISSLLLLLPLMLMSMVS

SEQ ID NO: 206262 - protein, 20 aa, Homo sapiens
MFINIKSILWMCSTLIVTHA

SEQ ID NO: 206263 - protein, 16 aa, Homo sapiens
MKRVLVLLLAVAFGHA

SEQ ID NO: 206264 - protein, 32 aa, Homo sapiens
MWQLTSLLLFVATWGISGTPAPLDSVFSSSER

SEQ ID NO: 206265 - protein, 24 aa, Homo sapiens
MRVLGGRCGALLACLLLVLPVSEA

SEQ ID NO: 206266 - protein, 23 aa, Homo sapiens
MAGCVPLLQGLVLVLALHRVEPS

SEQ ID NO: 206267 - protein, 24 aa, Homo sapiens
MERGAGAKLLPLLLLLRATGFTCA

SEQ ID NO: 206268 - protein, 19 aa, Homo sapiens
MAPLRPLLILALLAWVALA

SEQ ID NO: 206269 - protein, 22 aa, Homo sapiens
MIPARFAGVLLALALILPGTLC

SEQ ID NO: 206270 - protein, 23 aa, Homo sapiens
MAELPGPFLCGALLGFLCLSGLA

SEQ ID NO: 206271 - protein, 19 aa, Homo sapiens
MGILLGLLLLGHLTVDTYG

SEQ ID NO: 206272 - protein, 16 aa, Homo sapiens
MTAEFLSLLCLGLCLG

SEQ ID NO: 206273 - protein, 23 aa, Homo sapiens
MRGTPKTHLLAFSLLCLLSKVRT

SEQ ID NO: 206274 - protein, 28 aa, Homo sapiens
MARKLSVILILTFALSVTNPLHELKAAA

SEQ ID NO: 206275 - protein, 17 aa, Homo sapiens
MVPVLLSLLLLLGPAVP

SEQ ID NO: 206276 - protein, 38 aa, Homo sapiens
MACRQRGGSWSPSGWFNAGWSTYRSISLFFALVTSGNS

SEQ ID NO: 206277 - protein, 16 aa, Homo sapiens
MLTVALLALLCASASG

SEQ ID NO: 206278 - protein, 8 aa, Artificial Sequence
  Description of Artificial Sequence: Synthetic peptide
  MOD_RES (1)..(3): Any amino acid
  MOD_RES (4)..(5): Arg or Lys
  MOD_RES (6)..(8): Any amino acid
XXXXXXXX

SEQ ID NO: 206279 - protein, 3 aa, Artificial Sequence
  Description of Artificial Sequence: Synthetic peptide
  MOD_RES (1)..(1): Lys or Arg
  MOD_RES (2)..(3): Any amino acid
XXX

SEQ ID NO: 206280 - protein, 6 aa, Artificial Sequence
  Description of Artificial Sequence: Synthetic peptide
  MOD_RES (1)..(6): Any amino acid except Ser
XXXXXX

SEQ ID NO: 206281 - protein, 6 aa, Artificial Sequence
  Description of Artificial Sequence: Synthetic peptide
  MOD_RES (1)..(6): Any amino acid except Gly
XXXXXX

SEQ ID NO: 206282 - protein, 6 aa, Artificial Sequence
  Description of Artificial Sequence: Synthetic peptide
  MOD_RES (1)..(6): Any amino acid except Pro
XXXXXX

SEQ ID NO: 206283 - protein, 10 aa, Artificial Sequence
  Description of Artificial Sequence: Synthetic peptide
  MOD_RES (1)..(5): Any amino acid
  MOD_RES (6)..(7): Phe, Trp, His or Tyr
  MOD_RES (8)..(10): Any amino acid
XXXXXXXXXX

SEQ ID NO: 206284 - protein, 8 aa, Artificial Sequence
  Description of Artificial Sequence: Synthetic peptide
  MOD_RES (1)..(1): Phe, Trp, Tyr or Leu
  MOD_RES (2)..(2): Any amino acid
  MOD_RES (3)..(3): His, Ala or Thr
  MOD_RES (5)..(5): Any amino acid except Pro, Glu, Asp, Gln or Lys
  MOD_RES (6)..(8): Any amino acid
XXXDXXXX

SEQ ID NO: 206285 - protein, 8 aa, Artificial Sequence
  Description of Artificial Sequence: Synthetic peptide
  MOD_RES (5)..(5): Any amino acid except Pro, Glu, Asp, Gln or Lys
  MOD_RES (6)..(8): Any amino acid
DVADXXXX

SEQ ID NO: 206286 - protein, 8 aa, Artificial Sequence
  Description of Artificial Sequence: Synthetic peptide
  MOD_RES (5)..(5): Any amino acid except Pro, Glu, Asp, Gln or Lys
  MOD_RES (6)..(8): Any amino acid
DMQDXXXX

SEQ ID NO: 206287 - protein, 8 aa, Artificial Sequence
  Description of Artificial Sequence: Synthetic peptide
  MOD_RES (5)..(5): Any amino acid except Pro, Glu, Asp, Gln or Lys
  MOD_RES (6)..(8): Any amino acid
LEVDXXXX

SEQ ID NO: 206288 - protein, 8 aa, Artificial Sequence
  Description of Artificial Sequence: Synthetic peptide
  MOD_RES (1)..(1): Leu or Trp
  MOD_RES (5)..(8): Any amino acid
XEHDXXXX

SEQ ID NO: 206289 - protein, 8 aa, Artificial Sequence
  Description of Artificial Sequence: Synthetic peptide
  MOD_RES (3)..(3): His or Ile
  MOD_RES (5)..(5): Any amino acid except Pro, Glu, Asp, Gln or Lys
  MOD_RES (6)..(8): Any amino acid
VEXDXXXX

SEQ ID NO: 206290 - protein, 8 aa, Artificial Sequence
  Description of Artificial Sequence: Synthetic peptide
  MOD_RES (5)..(5): Any amino acid except Pro, Glu, Asp, Gln or Lys
  MOD_RES (6)..(8): Any amino acid
DEVDXXXX

SEQ ID NO: 206291 - protein, 10 aa, Artificial Sequence
  Description of Artificial Sequence: Synthetic peptide
  MOD_RES (1)..(2): Any amino acid
  MOD_RES (8)..(10): Any amino acid
XXIQADSXXX

SEQ ID NO: 206292 - protein, 10 aa, Artificial Sequence
  Description of Artificial Sequence: Synthetic peptide
  MOD_RES (1)..(2): Any amino acid
  MOD_RES (3)..(3): Val, Leu, Ile or Ala
  MOD_RES (5)..(5): Any amino acid
  MOD_RES (7)..(7): Ser, Gly or Ala
  MOD_RES (8)..(10): Any amino acid
XXXEXDXXXX

SEQ ID NO: 206293 - protein, 8 aa, Artificial Sequence
  Description of Artificial Sequence: Synthetic peptide
  MOD_RES (5)..(8): Any amino acid
LEHDXXXX

SEQ ID NO: 206294 - protein, 8 aa, Artificial Sequence
  Description of Artificial Sequence: Synthetic peptide
  MOD_RES (5)..(8): Any amino acid
IEADXXXX

SEQ ID NO: 206295 - protein, 8 aa, Artificial Sequence
  Description of Artificial Sequence: Synthetic peptide
  MOD_RES (1)..(2): Any amino acid
  MOD_RES (5)..(8): Any amino acid
XXRRXXXX

SEQ ID NO: 206296 - protein, 10 aa, Artificial Sequence
  Description of Artificial Sequence: Synthetic peptide
  MOD_RES (1)..(5): Any amino acid
  MOD_RES (6)..(6): Glu, Lys, Trp or Phe
  MOD_RES (7)..(10): Any amino acid
XXXXXXXXXX

SEQ ID NO: 206297 - protein, 9 aa, Artificial Sequence
  Description of Artificial Sequence: Synthetic peptide
  MOD_RES (1)..(4): Any amino acid
  MOD_RES (6)..(9): Any amino acid
XXXXRXXXX

SEQ ID NO: 206298 - protein, 8 aa, Artificial Sequence
  Description of Artificial Sequence: Synthetic peptide
  MOD_RES (1)..(2): Any amino acid
  MOD_RES (3)..(3): Leu, Met or Phe
  MOD_RES (4)..(8): Any amino acid
XXXXXXXX

SEQ ID NO: 206299 - protein, 8 aa, Artificial Sequence
  Description of Artificial Sequence: Synthetic peptide
  MOD_RES (1)..(2): Any amino acid
  MOD_RES (5)..(8): Any amino acid
XXRRXXXX

SEQ ID NO: 206300 - protein, 8 aa, Artificial Sequence
  Description of Artificial Sequence: Synthetic peptide
  MOD_RES (1)..(1): Any amino acid
  MOD_RES (5)..(8): Any amino acid
XVVRXXXX

SEQ ID NO: 206301 - protein, 4 aa, Artificial Sequence
  Description of Artificial Sequence: Synthetic peptide
  MOD_RES (1)..(1): Any amino acid
  MOD_RES (2)..(2): Phe, Leu or Val
  MOD_RES (4)..(4): Any amino acid
XXRX

SEQ ID NO: 206302 - protein, 8 aa, Artificial Sequence
  Description of Artificial Sequence: Synthetic peptide
  MOD_RES (1)..(4): Any amino acid
  MOD_RES (6)..(6): Any amino acid except Glu or Asp
  MOD_RES (7)..(8): Any amino acid
XXXXRXXX

SEQ ID NO: 206303 - protein, 8 aa, Artificial Sequence
  Description of Artificial Sequence: Synthetic peptide
  MOD_RES (1)..(3): Any amino acid
  MOD_RES (4)..(4): Phe, Tyr, Trp or Leu
  MOD_RES (5)..(8): Any amino acid
XXXXXXXX

SEQ ID NO: 206304 - protein, 8 aa, Artificial Sequence
  Description of Artificial Sequence: Synthetic peptide
  MOD_RES (1)..(3): Any amino acid
  MOD_RES (4)..(4): Val or Ala
  MOD_RES (5)..(8): Any amino acid
XXXXXXXX

SEQ ID NO: 206305 - protein, 10 aa, Artificial Sequence
  Description of Artificial Sequence: Synthetic peptide
  MOD_RES (1)..(5): Any amino acid
  MOD_RES (7)..(10): Any amino acid
XXXXXAXXXX

SEQ ID NO: 206306 - protein, 7 aa, Artificial Sequence
  Description of Artificial Sequence: Synthetic peptide
  MOD_RES (1)..(3): Any amino acid
  MOD_RES (5)..(7): Any amino acid
XXXEXXX

SEQ ID NO: 206307 - protein, 7 aa, Artificial Sequence
  Description of Artificial Sequence: Synthetic peptide
  MOD_RES (1)..(3): Any amino acid
  MOD_RES (5)..(7): Any amino acid
XXXDXXX

SEQ ID NO: 206308 - protein, 10 aa, Artificial Sequence
  Description of Artificial Sequence: Synthetic peptide
  MOD_RES (1)..(5): Any amino acid
  MOD_RES (7)..(10): Any amino acid
XXXXXKXXXX

SEQ ID NO: 206309 - protein, 8 aa, Artificial Sequence
  Description of Artificial Sequence: Synthetic peptide
  MOD_RES (1)..(3): Any amino acid
  MOD_RES (4)..(4): Cysteic acid
  MOD_RES (6)..(8): Any amino acid
XXXXDXXX

SEQ ID NO: 206310 - protein, 8 aa, Artificial Sequence
  Description of Artificial Sequence: Synthetic peptide
  MOD_RES (6)..(8): Any amino acid
DDDDKXXX

SEQ ID NO: 206311 - protein, 7 aa, Artificial Sequence
  Description of Artificial Sequence: Synthetic peptide
  MOD_RES (1)..(1): Ile or Ala
  MOD_RES (2)..(2): Glu or Asp
  MOD_RES (5)..(7): Any amino acid
XXGRXXX

SEQ ID NO: 206312 - protein, 7 aa, Artificial Sequence
  Description of Artificial Sequence: Synthetic peptide
  MOD_RES (1)..(3): Any amino acid
  MOD_RES (5)..(7): Any amino acid
XXXDXXX

SEQ ID NO: 206313 - protein, 8 aa, Artificial Sequence
  Description of Artificial Sequence: Synthetic peptide
  MOD_RES (1)..(2): Any amino acid
  MOD_RES (3)..(3): Arg or Lys
  MOD_RES (5)..(5): Any small, hydrophilic amino acid
  MOD_RES (6)..(6): Any aliphatic amino acid
  MOD_RES (7)..(8): Any amino acid
XXXRXXXX

SEQ ID NO: 206314 - protein, 6 aa, Artificial Sequence
  Description of Artificial Sequence: Synthetic peptide
  MOD_RES (2)..(2): Ala or Val
  MOD_RES (3)..(3): Pro or Val
  MOD_RES (5)..(5): Any amino acid except Pro or Asp
  MOD_RES (6)..(6): Any amino acid except Pro
DXXDXX

SEQ ID NO: 206315 - protein, 6 aa, Artificial Sequence
  Description of Artificial Sequence: Synthetic peptide
  MOD_RES (5)..(6): Any amino acid
IEPDXX

SEQ ID NO: 206316 - protein, 8 aa, Artificial Sequence
  Description of Artificial Sequence: Synthetic peptide
LEVLFQGP

SEQ ID NO: 206317 - protein, 8 aa, Artificial Sequence
  Description of Artificial Sequence: Synthetic peptide
  MOD_RES (1)..(3): Any amino acid
  MOD_RES (6)..(8): Any amino acid
XXXNGXXX

SEQ ID NO: 206318 - protein, 9 aa, Artificial Sequence
  Description of Artificial Sequence: Synthetic peptide
  MOD_RES (1)..(4): Any amino acid
  MOD_RES (6)..(9): Any amino acid
XXXXWXXXX

SEQ ID NO: 206319 - protein, 8 aa, Artificial Sequence
  Description of Artificial Sequence: Synthetic peptide
  MOD_RES (1)..(3): Any amino acid
  MOD_RES (4)..(4): Leu or Pro
  MOD_RES (6)..(8): Any amino acid
XXXXPXXX

SEQ ID NO: 206320 - protein, 9 aa, Artificial Sequence
  Description of Artificial Sequence: Synthetic peptide
  MOD_RES (1)..(4): Any amino acid
  MOD_RES (6)..(9): Any amino acid
XXXXKXXXX

SEQ ID NO: 206321 - protein, 9 aa, Artificial Sequence
  Description of Artificial Sequence: Synthetic peptide
  MOD_RES (1)..(4): Any amino acid
  MOD_RES (6)..(9): Any amino acid
XXXXKXXXX

SEQ ID NO: 206322 - protein, 10 aa, Artificial Sequence
  Description of Artificial Sequence: Synthetic peptide
  MOD_RES (1)..(1): Any amino acid
  MOD_RES (2)..(2): Asp, Leu, Phe, Asn or Ile
  MOD_RES (3)..(3): Ile or Val
  MOD_RES (4)..(4): Pro, Val or Ile
  MOD_RES (5)..(5): Val or Ala
  MOD_RES (6)..(6): Ser, Gly, Ala or Glu
  MOD_RES (7)..(7): Leu, Met, Ile, Tyr or Phe
  MOD_RES (8)..(8): Arg, Tyr, Lys, Met, Ile or Val
  MOD_RES (9)..(9): Ser, Ala or Gly
  MOD_RES (10)..(10): Any amino acid
XXXXXXXXXX

SEQ ID NO: 206323 - protein, 10 aa, Artificial Sequence
  Description of Artificial Sequence: Synthetic peptide
  MOD_RES (1)..(1): Any amino acid
  MOD_RES (2)..(2): Asn or Ile
  MOD_RES (3)..(3): Lys, Val, Ile or Arg
  MOD_RES (4)..(4): Pro, Val or Ile
  MOD_RES (5)..(5): Phe, Tyr, Leu, Met or Ala
  MOD_RES (6)..(6): Ser or Glu
  MOD_RES (7)..(7): Met, Ile, Lys, Tyr or Phe
  MOD_RES (8)..(8): Met, Lys, Ile or Arg
  MOD_RES (9)..(9): Met or Ala
  MOD_RES (10)..(10): Any amino acid
XXXXXXXXXX

SEQ ID NO: 206324 - protein, 8 aa, Artificial Sequence
  Description of Artificial Sequence: Synthetic peptide
  MOD_RES (1)..(1): Any amino acid
  MOD_RES (4)..(5): Gly or Ala
  MOD_RES (8)..(8): Any amino acid
XGPXXPAX

SEQ ID NO: 206325 - protein, 8 aa, Artificial Sequence
  Description of Artificial Sequence: Synthetic peptide
  MOD_RES (1)..(3): Any amino acid
  MOD_RES (4)..(5): Arg or Lys
  MOD_RES (6)..(8): Any amino acid
XXXXXXXX

SEQ ID NO: 206326 - protein, 10 aa, Artificial Sequence
  Description of Artificial Sequence: Synthetic peptide
  MOD_RES (1)..(5): Any amino acid
  MOD_RES (6)..(7): Phe, Tyr, Trp or Leu
  MOD_RES (8)..(10): Any amino acid
XXXXXXXXXX

SEQ ID NO: 206327 - protein, 1002 aa, Artificial Sequence
  Description of Artificial Sequence: Synthetic polypeptide
  MOD_RES (1)..(1000): Any amino acid
  MISC_FEATURE (1)..(1000): This region may encompass 5-1000 residues, wherein some positions may be absent
  MOD_RES (1001)..(1001): Any amino acid except Pro
  MOD_RES (1002)..(1002): Any amino acid except Asp or Glu
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 206328 - protein, 8 aa, Artificial Sequence
  Description of Artificial Sequence: Synthetic peptide
  MOD_RES (1)..(3): Any amino acid
  MOD_RES (4)..(5): Phe, Val, Ile, Leu or Ala
  MOD_RES (6)..(8): Any amino acid
XXXXXXXX

SEQ ID NO: 206329 - protein, 7 aa, Artificial Sequence
  Description of Artificial Sequence: Synthetic peptide
  MOD_RES (1)..(3): Any amino acid
  MOD_RES (4)..(4): Lys or Arg
  MOD_RES (5)..(7): Any amino acid
XXXXXXX

SEQ ID NO: 206330 - protein, 8 aa, Artificial Sequence
  Description of Artificial Sequence: Synthetic peptide
LEVLFQGP

SEQ ID NO: 206331 - protein, 8 aa, Artificial Sequence
  Description of Artificial Sequence: Synthetic peptide
  MOD_RES (1)..(2): Any amino acid
  MOD_RES (3)..(3): Lys, His or Arg
  MOD_RES (5)..(5): Any amino acid except Pro
  MOD_RES (6)..(8): Any amino acid
XXXPXXXX

SEQ ID NO: 206332 - protein, 7 aa, Artificial Sequence
  Description of Artificial Sequence: Synthetic peptide
ENLYFQG

SEQ ID NO: 206333 - protein, 10 aa, Artificial Sequence
  Description of Artificial Sequence: Synthetic peptide
  MOD_RES (1)..(6): Any amino acid
  MOD_RES (7)..(7): Leu, Phe, Ile, Val, Met or Ala
  MOD_RES (8)..(10): Any amino acid
XXXXXXXXXX

SEQ ID NO: 206334 - protein, 6 aa, Artificial Sequence
  Description of Artificial Sequence: Synthetic peptide
LVPRGS

SEQ ID NO: 206335 - protein, 6 aa, Artificial Sequence
  Description of Artificial Sequence: Synthetic peptide
  MOD_RES (1)..(3): Any amino acid
  MOD_RES (4)..(4): Lys or Arg
  MOD_RES (5)..(6): Any amino acid
XXXXXX

SEQ ID NO: 206336 - protein, 15 aa, Artificial Sequence
  Description of Artificial Sequence: Synthetic peptide
GLNDIFEAQKIEWHE

SEQ ID NO: 206337 - protein, 130 aa, Artificial Sequence
  Description of Artificial Sequence: Synthetic polypeptide
MLRKFKISIDGKEYLVEMEEISESSVPAATPITPTTENTRAASDQKQQSQTPSPAATASAANTMPAPMPGTILKVLVNVGDTVSENQPLMILEAMKMENEIVAGMAGTVSAIHVSSGQTVNAGDNLITIA

SEQ ID NO: 206338 - protein, 26 aa, Artificial Sequence
  Description of Artificial Sequence: Synthetic peptide
KRRWKKNFIAVSAANRFKKISSSGAL

SEQ ID NO: 206339 - protein, 50 aa, Artificial Sequence
  Description of Artificial Sequence: Synthetic polypeptide
TNPGVSAWQVNTAYTAQLVTYNGKTYKCLQPHTSLAGWEPSNVPALWQLQ

SEQ ID NO: 206340 - protein, 13 aa, Artificial Sequence
  Description of Artificial Sequence: Synthetic peptide
GAPVPYPDPLEPR

SEQ ID NO: 206341 - protein, 296 aa, Artificial Sequence
  Description of Artificial Sequence: Synthetic polypeptide
MLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANSTDPVKAAQFEPPGRQMIAIRKRQPEETNNDYETADGGYMTLNPRAPTDDDKNIYLTLPPNDHVNSNN

SEQ ID NO: 206342 - protein, 8 aa, Artificial Sequence
  Description of Artificial Sequence: Synthetic peptide
DYKDDDDK

SEQ ID NO: 206343 - protein, 238 aa, Artificial Sequence
  Description of Artificial Sequence: Synthetic polypeptide
MSKGEELFTGVVPILVELDGDVNGHKFSVSGEGEGDATYGKLTLKFICTTGKLPVPWPTLVTTFAYGVQCFSRYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSVLSKDPNEKRDHMVLLEFVTAAGITHGMDELYK

SEQ ID NO: 206344 - protein, 239 aa, Artificial Sequence
  Description of Artificial Sequence: Synthetic polypeptide
MVSKGEELFTGVVPILVELDGDVNGHKFSVSGEGEGDATYGKLTLKFICTTGKLPVPWPTLVTTLTWGVQCFSRYPDHMKQHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 206345 - protein, 225 aa, Artificial Sequence
  Description of Artificial Sequence: Synthetic polypeptide
MASSEDVIKEFMRFKVRMEGSVNGHEFEIEGEGEGRPYEGTQTAKLKVTKGGPLPFAWDILSPQFQYGSKAYVKHPADIPDYLKLSFPEGFKWERVMNFEDGGVVTVTQDSSLQDGEFIYKVKLRGTNFPSDGPVMQKKTMGWEASTERMYPEDGALKGEIKMRLKLKDGGHYDAEVKTTYMAKKPVQLPGAYKTDIKLDITSHNEDYTIVEQYERAEGRHSTGA

SEQ ID NO: 206346 - protein, 239 aa, Artificial Sequence
  Description of Artificial Sequence: Synthetic polypeptide
MVSKGEELFTGVVPILVELDGDVNGHKFSVSGEGEGDATYGKLTLKFICTTGKLPVPWPTLVTTFGYGLQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 206347 - protein, 201 aa, Artificial Sequence
  Description of Artificial Sequence: Synthetic polypeptide
MKLFYKPGACSLASHITLRESGKDFTLVSVDLMKKRLENGDNYFAVNPKGQVPALLLDDGTLLTEGVAIMQYLADSVPDRQLLAPVNSISRYKTIEWLNYIATELHKGFTPLFRPDTPEEYKSTVRAQLEKKLQYVNEALKDEHWICGQRFTIADAYLFTVLRWAYAVKLNLEGLEHIAAFMQRMAERPEVQDALSAEGLK

SEQ ID NO: 206348 - protein, 90 aa, Artificial Sequence
  Description of Artificial Sequence: Synthetic polypeptide
MVARTLSATTGELPSRGCSRRIVPISSASDGVHALVLHQRAIGSAGVDATAHYVSGPYRRETLVGTSHWIPDEEPEKLARLVLEHIAAHG

SEQ ID NO: 206349 - protein, 19 aa, Artificial Sequence
  Description of Artificial Sequence: Synthetic peptide
KDHLIHNVHKEFHAHAHNK

SEQ ID NO: 206350 - protein, 9 aa, Artificial Sequence
  Description of Artificial Sequence: Synthetic peptide
YPYDVPDYA

SEQ ID NO: 206351 - protein, 16 aa, Artificial Sequence
  Description of Artificial Sequence: Synthetic peptide
TDKDMTITFTNKKDAE

SEQ ID NO: 206352 - protein, 396 aa, Artificial Sequence
  Description of Artificial Sequence: Synthetic polypeptide
MKIKTGARILALSALTTMMFSASALAKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTRITK

SEQ ID NO: 206353 - protein, 10 aa, Artificial Sequence
  Description of Artificial Sequence: Synthetic peptide
EQKLISEEDL

SEQ ID NO: 206354 - protein, 6 aa, Artificial Sequence
  Description of Artificial Sequence: Synthetic peptide
HHHHHH

SEQ ID NO: 206355 - protein, 5 aa, Artificial Sequence
  Description of Artificial Sequence: Synthetic peptide
RRRRR

SEQ ID NO: 206356 - protein, 6 aa, Artificial Sequence
  Description of Artificial Sequence: Synthetic peptide
EEEEEE

SEQ ID NO: 206357 - protein, 38 aa, Artificial Sequence
  Description of Artificial Sequence: Synthetic polypeptide
MDEKTTGWRGGHVVEGLAGELEQLRARLEHHPQGQREP

SEQ ID NO: 206358 - protein, 12 aa, Artificial Sequence
  Description of Artificial Sequence: Synthetic peptide
KLGDIEFIKVNK

SEQ ID NO: 206359 - protein, 13 aa, Artificial Sequence
  Description of Artificial Sequence: Synthetic peptide
SLAELLNAGLGGS

SEQ ID NO: 206360 - protein, 13 aa, Artificial Sequence
  Description of Artificial Sequence: Synthetic peptide
AHIVMVDAYKPTK

SEQ ID NO: 206361 - protein, 15 aa, Artificial Sequence
  Description of Artificial Sequence: Synthetic peptide
KETAAAKFERQHMDS

SEQ ID NO: 206362 - protein, 8 aa, Artificial Sequence
  Description of Artificial Sequence: Synthetic peptide
WSHPQFEK

SEQ ID NO: 206363 - protein, 6 aa, Artificial Sequence
  Description of Artificial Sequence: Synthetic peptide
CCPGCC

SEQ ID NO: 206364 - protein, 139 aa, Artificial Sequence
  Description of Artificial Sequence: Synthetic polypeptide
MNTVCTHCQAINRIPDDRIEDAAKCGRCGHDLFDGEVINATGETLDKLLKDDLPVVIDFWAPWCGPCRNFAPIFEDVAQERSGKVRFVKVNTEAERELSSRFGIRSIPTIMIFKNGQVVDMLNGAVPKAPFDSWLNESL

SEQ ID NO: 206365 - protein, 14 aa, Artificial Sequence
  Description of Artificial Sequence: Synthetic peptide
GKPIPNPLLGLDST

SEQ ID NO: 206366 - protein, 11 aa, Artificial Sequence
  Description of Artificial Sequence: Synthetic peptide
YTDIEMNRLGK

SEQ ID NO: 206367 - protein, 8 aa, Artificial Sequence
  Description of Artificial Sequence: Synthetic peptide
DLYDDDDK

SEQ ID NO: 206368 - protein, 16 aa, Artificial Sequence
  Description of Artificial Sequence: Synthetic peptide
CKSIHIGPGRAFYTTG

SEQ ID NO: 206369 - protein, 16 aa, Artificial Sequence
  Description of Artificial Sequence: Synthetic peptide
CKGIRIGPGRAVYAAE

SEQ ID NO: 206370 - protein, 28 aa, Artificial Sequence
  Description of Artificial Sequence: Synthetic peptide
CARRPKFYRAPYVKNHPNVWGPWVAYGP

SEQ ID NO: 206371 - protein, 103 aa, Artificial Sequence
  Description of Artificial Sequence: Synthetic polypeptide
TPQNITDLCAEYHNTQIYTLNDKIFSYTESLAGKREMAIITFKNGAIFQVEVPGSQHIDSQKKAIERMKDTLRIAYLTEAKVEKLCVWNNKTPHAIAAISMAN

SEQ ID NO: 206372 - protein, 22 aa, Artificial Sequence
  Description of Artificial Sequence: Synthetic peptide
DKLTTREIEQVELLKRIKDKLT

SEQ ID NO: 206373 - protein, 28 aa, Artificial Sequence
  Description of Artificial Sequence: Synthetic peptide
EIEQVELLKRIYDKLTVQTTGEIDMTKE

SEQ ID NO: 206374 - protein, 21 aa, Artificial Sequence
  Description of Artificial Sequence: Synthetic peptide
EKLTDLNYTLSVITLMNNTLH

SEQ ID NO: 206375 - protein, 33 aa, Artificial Sequence
  Description of Artificial Sequence: Synthetic polypeptide
TKDEIEKQMDRVVKEMRRQLEMIDKLTTREIEQ

SEQ ID NO: 206376 - protein, 12 aa, Artificial Sequence
  Description of Artificial Sequence: Synthetic peptide
HLNILSTLWKYR

SEQ ID NO: 206377 - protein, 9 aa, Artificial Sequence
  Description of Artificial Sequence: Synthetic peptide
KRTGQYKLC

SEQ ID NO: 206378 - protein, 5 aa, Artificial Sequence
  Description of Artificial Sequence: Synthetic peptide
DEVDG

SEQ ID NO: 206379 - protein, 13 aa, Artificial Sequence
  Description of Artificial Sequence: Synthetic peptide
RLVSYNGIIFFLK

SEQ ID NO: 206380 - protein, 15 aa, Artificial Sequence
  Description of Artificial Sequence: Synthetic peptide
GVKGDKGNPGWPGAP

SEQ ID NO: 206381 - protein, 11 aa, Artificial Sequence
  Description of Artificial Sequence: Synthetic peptide
LGASWHRPDKG

SEQ ID NO: 206382 - protein, 6 aa, Artificial Sequence
  Description of Artificial Sequence: Synthetic peptide
QRLGNQ

SEQ ID NO: 206383 - protein, 9 aa, Artificial Sequence
  Description of Artificial Sequence: Synthetic peptide
NQWAVGHLM

SEQ ID NO: 206384 - protein, 19 aa, Artificial Sequence
  Description of Artificial Sequence: Synthetic peptide
ASSYASCIWCTTACASCHG

SEQ ID NO: 206385 - protein, 14 aa, Artificial Sequence
  Description of Artificial Sequence: Synthetic peptide
CCEFCCNPACTGCY

SEQ ID NO: 206386 - protein, 18 aa, Artificial Sequence
  Description of Artificial Sequence: Synthetic peptide
SSNYCCELCCNPACTGCF

SEQ ID NO: 206387 - protein, 18 aa, Artificial Sequence
  Description of Artificial Sequence: Synthetic peptide
NTFYCCELCCNPACTGCY

SEQ ID NO: 206388 - protein, 11 aa, Artificial Sequence
  Description of Artificial Sequence: Synthetic peptide
RCPLSHSLICY

SEQ ID NO: 206389 - protein, 10 aa, Artificial Sequence
  Description of Artificial Sequence: Synthetic peptide
QHWSYKCLRP

SEQ ID NO: 206390 - protein, 20 aa, Artificial Sequence
  Description of Artificial Sequence: Synthetic peptide
GNLIDCCEICCNPACFGCLN

SEQ ID NO: 206391 - protein, 18 aa, Artificial Sequence
  Description of Artificial Sequence: Synthetic peptide
SSDWDCCDVCCNPACAGC

SEQ ID NO: 206392 - protein, 8 aa, Artificial Sequence
  Description of Artificial Sequence: Synthetic peptide
WQPPRARI

SEQ ID NO: 206393 - protein, 12 aa, Artificial Sequence
  Description of Artificial Sequence: Synthetic peptide
QNIYAGVPMISF

SEQ ID NO: 206394 - protein, 12 aa, Artificial Sequence
  Description of Artificial Sequence: Synthetic peptide
EATNSHGSRTMG

SEQ ID NO: 206395 - protein, 12 aa, Artificial Sequence
  Description of Artificial Sequence: Synthetic peptide
TVSWSTTGRIPL

SEQ ID NO: 206396 - protein, 12 aa, Artificial Sequence
  Description of Artificial Sequence: Synthetic peptide
QLEFYTQLAHLI

SEQ ID NO: 206397 - protein, 11 aa, Artificial Sequence
  Description of Artificial Sequence: Synthetic peptide
SMDPFLFQLLQ

SEQ ID NO: 206398 - protein, 12 aa, Artificial Sequence
  Description of Artificial Sequence: Synthetic peptide
SFSIIHTPILPL

SEQ ID NO: 206399 - protein, 12 aa, Artificial Sequence
  Description of Artificial Sequence: Synthetic peptide
EDYELMDLLAYL

SEQ ID NO: 206400 - protein, 7 aa, Artificial Sequence
  Description of Artificial Sequence: Synthetic peptide
LTVSPWY

SEQ ID NO: 206401 - protein, 5 aa, Artificial Sequence
  Description of Artificial Sequence: Synthetic peptide
GRGDS

SEQ ID NO: 206402 - protein, 7 aa, Artificial Sequence
  Description of Artificial Sequence: Synthetic peptide
RGERPPR

SEQ ID NO: 206403 - protein, 28 aa, Artificial Sequence
  Description of Artificial Sequence: Synthetic peptide
HSDAVFTDNYTRLRKQMAVKKYLNSILN

SEQ ID NO: 206404 - protein, 10 aa, Artificial Sequence
  Description of Artificial Sequence: Synthetic peptide
IAGEDGDEFG

SEQ ID NO: 206405 - protein, 6 aa, Artificial Sequence
  Description of Artificial Sequence: Synthetic peptide
PLGLAG

SEQ ID NO: 206406 - protein, 6 aa, Artificial Sequence
  Description of Artificial Sequence: Synthetic peptide
  MOD_RES (2)..(2): D-Trp
  MOD_RES (3)..(3): N(Me)-Phe
  MOD_RES (4)..(4): D-Trp
RWFWLM

SEQ ID NO: 206407 - protein, 7 aa, Artificial Sequence
  Description of Artificial Sequence: Synthetic peptide
VHLGYAT

SEQ ID NO: 206408 - protein, 7 aa, Artificial Sequence
  Description of Artificial Sequence: Synthetic peptide
IRQRRRR

SEQ ID NO: 206409 - protein, 12 aa, Artificial Sequence
  Description of Artificial Sequence: Synthetic peptide
RLLDTNRPLLPY

SEQ ID NO: 206410 - protein, 12 aa, Artificial Sequence
  Description of Artificial Sequence: Synthetic peptide
VPWMEPAYQRFL

SEQ ID NO: 206411 - protein, 9 aa, Artificial Sequence
  Description of Artificial Sequence: Synthetic peptide
CPIEDRPMC

SEQ ID NO: 206412 - protein, 23 aa, Artificial Sequence
  Description of Artificial Sequence: Synthetic peptide
CPIEDRPMCKLAKLAKKLAKLAK

SEQ ID NO: 206413 - protein, 12 aa, Artificial Sequence
  Description of Artificial Sequence: Synthetic peptide
VTWTPQAWFQWV

SEQ ID NO: 206414 - protein, 5 aa, Artificial Sequence
  Description of Artificial Sequence: Synthetic peptide
YIGSR

SEQ ID NO: 206415 - protein, 9 aa, Artificial Sequence
  Description of Artificial Sequence: Synthetic peptide
CPRECESIC

SEQ ID NO: 206416 - protein, 7 aa, Artificial Sequence
  Description of Artificial Sequence: Synthetic peptide
IFLLWQR

SEQ ID NO: 206417 - protein, 31 aa, Artificial Sequence
  Description of Artificial Sequence: Synthetic polypeptide
KDEPQRRSARLSAKPAPPKPEPKPKKAPAKK

SEQ ID NO: 206418 - protein, 10 aa, Artificial Sequence
  Description of Artificial Sequence: Synthetic peptide
CGLIIQKNEC

SEQ ID NO: 206419 - protein, 5 aa, Artificial Sequence
  Description of Artificial Sequence: Synthetic peptide
CREKA

SEQ ID NO: 206420 - protein, 10 aa, Artificial Sequence
  Description of Artificial Sequence: Synthetic peptide
CTTHWGFTLC

SEQ ID NO: 206421 - protein, 10 aa, Artificial Sequence
  Description of Artificial Sequence: Synthetic peptide
TAASGVRSMH

SEQ ID NO: 206422 - protein, 10 aa, Artificial Sequence
  Description of Artificial Sequence: Synthetic peptide
LTLRWVGLMS

SEQ ID NO: 206423 - protein, 9 aa, Artificial Sequence
  Description of Artificial Sequence: Synthetic peptide
CGNKRTRGC

SEQ ID NO: 206424 - protein, 7 aa, Artificial Sequence
  Description of Artificial Sequence: Synthetic peptide
CRGRRST

SEQ ID NO: 206425 - protein, 9 aa, Artificial Sequence
  Description of Artificial Sequence: Synthetic peptide
CAGRRSAYC

SEQ ID NO: 206426 - protein, 10 aa, Artificial Sequence
  Description of Artificial Sequence: Synthetic peptide
CNAGESSKNC

SEQ ID NO: 206427 - protein, 9 aa, Artificial Sequence
  Description of Artificial Sequence: Synthetic peptide
CGNSNPKSC

SEQ ID NO: 206428 - protein, 12 aa, Artificial Sequence
  Description of Artificial Sequence: Synthetic peptide
HTMYYHHYQHHL

SEQ ID NO: 206429 - protein, 7 aa, Artificial Sequence
  Description of Artificial Sequence: Synthetic peptide
CKAAKNK

SEQ ID NO: 206430 - protein, 7 aa, Artificial Sequence
  Description of Artificial Sequence: Synthetic peptide
CKGAKAR

SEQ ID NO: 206431 - protein, 5 aa, Artificial Sequence
  Description of Artificial Sequence: Synthetic peptide
CGKRK

SEQ ID NO: 206432 - protein, 9 aa, Artificial Sequence
  Description of Artificial Sequence: Synthetic peptide
CLSDGKRKC

SEQ ID NO: 206433 - protein, 9 aa, Artificial Sequence
  Description of Artificial Sequence: Synthetic peptide
CNRRTKAGC

SEQ ID NO: 206434 - protein, 9 aa, Artificial Sequence
  Description of Artificial Sequence: Synthetic peptide
CPGPEGAGC

SEQ ID NO: 206435 - protein, 9 aa, Artificial Sequence
  Description of Artificial Sequence: Synthetic peptide
CREAGRKAC

SEQ ID NO: 206436 - protein, 12 aa, Artificial Sequence
  Description of Artificial Sequence: Synthetic peptide
CMGNKRSAKRPC

SEQ ID NO: 206437 - protein, 6 aa, Artificial Sequence
  Description of Artificial Sequence: Synthetic peptide
CRSRKG

SEQ ID NO: 206438 - protein, 12 aa, Artificial Sequence
  Description of Artificial Sequence: Synthetic peptide
SVSVGMKPSPRP

SEQ ID NO: 206439 - protein, 9 aa, Artificial Sequence
  Description of Artificial Sequence: Synthetic peptide
CTPSPFSHC

SEQ ID NO: 206440 - protein, 9 aa, Artificial Sequence
  Description of Artificial Sequence: Synthetic peptide
CSRPRRSEC

SEQ ID NO: 206441 - protein, 5 aa, Artificial Sequence
  Description of Artificial Sequence: Synthetic peptide
CDTRL

SEQ ID NO: 206442 - protein, 7 aa, Artificial Sequence
  Description of Artificial Sequence: Synthetic peptide
CGTKRKC

SEQ ID NO: 206443 - protein, 5 aa, Artificial Sequence
  Description of Artificial Sequence: Synthetic peptide
APRPG

SEQ ID NO: 206444 - protein, 12 aa, Artificial Sequence
  Description of Artificial Sequence: Synthetic peptide
GRKKRRQRRRPQ

SEQ ID NO: 206445 - protein, 21 aa, Artificial Sequence
  Description of Artificial Sequence: Synthetic peptide
KETWWETWWTEWSQPKKKRKV

SEQ ID NO: 206446 - protein, 39 aa, Artificial Sequence
  Description of Artificial Sequence: Synthetic polypeptide
KSVRTWNEIIPSKGCLRVGGRCHPHVNGGGRRRRRRRRR

SEQ ID NO: 206447 - protein, 29 aa, Artificial Sequence
  Description of Artificial Sequence: Synthetic peptide
YTIWMPENPRPGTPCDIFTNSRGKRASNG

SEQ ID NO: 206448 - protein, 13 aa, Artificial Sequence
  Description of Artificial Sequence: Synthetic peptide
APSGAQRLYGFGL

SEQ ID NO: 206449 - protein, 16 aa, Artificial Sequence
  Description of Artificial Sequence: Synthetic peptide
RQIKIWFQNRRMKWKK

SEQ ID NO: 206450 - protein, 18 aa, Artificial Sequence
  Description of Artificial Sequence: Synthetic peptide
LLIILRRRIRKQAHAHSK

SEQ ID NO: 206451 - protein, 21 aa, Artificial Sequence
  Description of Artificial Sequence: Synthetic peptide
AFLGWLGAWGTMGWSPKKKRK

SEQ ID NO: 206452 - protein, 27 aa, Artificial Sequence
  Description of Artificial Sequence: Synthetic peptide
GWTLNSAGYLLGKINLKALAALAKKIL

SEQ ID NO: 206453 - protein, 21 aa, Artificial Sequence
  Description of Artificial Sequence: Synthetic peptide
AGYLLGKINLKALAALAKKIL

SEQ ID NO: 206454 - protein, 21 aa, Artificial Sequence
  Description of Artificial Sequence: Synthetic peptide
AGYLLGKINLKALAALAKKIL

SEQ ID NO: 206455 - protein, 21 aa, Artificial Sequence
  Description of Artificial Sequence: Synthetic peptide
  MOD_RES (7)..(7): Lys(epsilon-NHa)
AGYLLGKINLKALAALAKKIL

SEQ ID NO: 206456 - protein, 21 aa, Artificial Sequence
  Description of Artificial Sequence: Synthetic peptide
  MOD_RES (10)..(11): Ornithine
  MOD_RES (18)..(19): Ornithine
AGYLLGKLLXXLAAAALXXLL

SEQ ID NO: 206457 - protein, 12 aa, Artificial Sequence
  Description of Artificial Sequence: Synthetic peptide
  MISC_FEATURE (1)..(12): This sequence may encompass 6-12 residues
RRRRRRRRRRRR

SEQ ID NO: 206458 - protein, 12 aa, Artificial Sequence
  Description of Artificial Sequence: Synthetic peptide
  MISC_FEATURE (1)..(12): This sequence may encompass 6-12 residues
RRRRRRRRRRRR

SEQ ID NO: 206459 - protein, 15 aa, Artificial Sequence
  Description of Artificial Sequence: Synthetic peptide
KWFETWFTEWPKKRK

SEQ ID NO: 206460 - protein, 20 aa, Artificial Sequence
  Description of Artificial Sequence: Synthetic peptide
GLWRALWRLLRSLWRLLWRA

SEQ ID NO: 206461 - protein, 16 aa, Artificial Sequence
  Description of Artificial Sequence: Synthetic peptide
YTAIAWVKAFIRKLRK

SEQ ID NO: 206462 - protein, 17 aa, Artificial Sequence
  Description of Artificial Sequence: Synthetic peptide
IAWVKAFIRKLRKGPLG

SEQ ID NO: 206463 - protein, 18 aa, Artificial Sequence
  Description of Artificial Sequence: Synthetic peptide
RGGRLSYSRRRFSTSTGR

SEQ ID NO: 206464 - protein, 10 aa, Artificial Sequence
  Description of Artificial Sequence: Synthetic peptide
RRLSYSRRRF

SEQ ID NO: 206465 - protein, 33 aa, Artificial Sequence
  Description of Artificial Sequence: Synthetic polypeptide
GDCLPHLKLCKENKDCCSKKCKRRGTNIEKRCR

SEQ ID NO: 206466 - protein, 11 aa, Artificial Sequence
  Description of Artificial Sequence: Synthetic peptide
YARAAARQARA

SEQ ID NO: 206467 - protein, 19 aa, Artificial Sequence
  Description of Artificial Sequence: Synthetic peptide
PFFYGGSGGNRNNYLREEY

SEQ ID NO: 206468 - protein, 19 aa, Artificial Sequence
  Description of Artificial Sequence: Synthetic peptide
RFFYGGSRGKRNNFRTEEY

SEQ ID NO: 206469 - protein, 11 aa, Artificial Sequence
  Description of Artificial Sequence: Synthetic peptide
YGRKKRRQRRR

SEQ ID NO: 206470 - protein, 14 aa, Artificial Sequence
  Description of Artificial Sequence: Synthetic peptide
  MOD_RES (2)..(2): Any amino acid
  MOD_RES (8)..(8): Any amino acid
  MOD_RES (13)..(13): Any amino acid
RXRRBRRXRRBRXB

SEQ ID NO: 206471 - protein, 17 aa, Artificial Sequence
  Description of Artificial Sequence: Synthetic peptide
RGGRLAYLRRRWAVLGR

SEQ ID NO: 206472 - protein, 12 aa, Artificial Sequence
  Description of Artificial Sequence: Synthetic peptide
AAVLLPVLLAAP

SEQ ID NO: 206473 - protein, 21 aa, Artificial Sequence
  Description of Artificial Sequence: Synthetic peptide
HHHHHYGRKKRRQRRRHHHHH

SEQ ID NO: 206474 - protein, 38 aa, Artificial Sequence
  Description of Artificial Sequence: Synthetic polypeptide
YTIWMPENPRPGTPCDIFTNSRGKRASNGRRRRRRRRR

SEQ ID NO: 206475 - protein, 20 aa, Artificial Sequence
  Description of Artificial Sequence: Synthetic peptide
YGRKKRRQRRRYPYDVPDVA

SEQ ID NO: 206476 - protein, 45 aa, Artificial Sequence
  Description of Artificial Sequence: Synthetic polypeptide
  MISC_FEATURE (16)..(45): This region may encompass 10-30 residues
QYIKANSKFIGITELKKKKKKKKKKKKKKKKKKKKKKKKKKKKKK

SEQ ID NO: 206477 - protein, 29 aa, Artificial Sequence
  Description of Artificial Sequence: Synthetic peptide
KWKLFKKIGAVLKVLTTGYGRKKRRQRRR

SEQ ID NO: 206478 - protein, 21 aa, Artificial Sequence
  Description of Artificial Sequence: Synthetic peptide
  MOD_RES (17)..(17): Aib
AGYLLGHINLHHLAHLXHHIL

SEQ ID NO: 206479 - protein, 17 aa, Artificial Sequence
  Description of Artificial Sequence: Synthetic peptide
RAGLQFPVGRLLRRLLR

SEQ ID NO: 206480 - protein, 7 aa, Artificial Sequence
  Description of Artificial Sequence: Synthetic peptide
LCLRPVG

SEQ ID NO: 206481 - protein, 10 aa, Artificial Sequence
  Description of Artificial Sequence: Synthetic peptide
NYRWRCKNQN

SEQ ID NO: 206482 - protein, 10 aa, Artificial Sequence
  Description of Artificial Sequence: Synthetic peptide
NYQRRCKNQN

SEQ ID NO: 206483 - protein, 10 aa, Artificial Sequence
  Description of Artificial Sequence: Synthetic peptide
NYQWRCKNQN

SEQ ID NO: 206484 - protein, 10 aa, Artificial Sequence
  Description of Artificial Sequence: Synthetic peptide
NYRRRCKNQN

SEQ ID NO: 206485 - protein, 9 aa, Artificial Sequence
  Description of Artificial Sequence: Synthetic peptide
YRWRCKNQN

SEQ ID NO: 206486 - protein, 9 aa, Artificial Sequence
  Description of Artificial Sequence: Synthetic peptide
NYRWRCKNQ

SEQ ID NO: 206487 - protein, 8 aa, Artificial Sequence
  Description of Artificial Sequence: Synthetic peptide
YRWRCKNQ

SEQ ID NO: 206488 - protein, 8 aa, Artificial Sequence
  Description of Artificial Sequence: Synthetic peptide
NYRWRCKN

SEQ ID NO: 206489 - protein, 8 aa, Artificial Sequence
  Description of Artificial Sequence: Synthetic peptide
RWRCKNQN

SEQ ID NO: 206490 - protein, 14 aa, Artificial Sequence
  Description of Artificial Sequence: Synthetic peptide
KLAKLAKKLAKLAK

SEQ ID NO: 206491 - protein, 5 aa, Artificial Sequence
  Description of Artificial Sequence: Synthetic peptide
  MOD_RES (2)..(4): Any amino acid
PXXXT

SEQ ID NO: 206492 - protein, 4 aa, Artificial Sequence
  Description of Artificial Sequence: Synthetic peptide
  MOD_RES (3)..(3): Any amino acid
PSXS

SEQ ID NO: 206493 - protein, 5 aa, Artificial Sequence
  Description of Artificial Sequence: Synthetic peptide
  MOD_RES (2)..(2): Any amino acid
  MOD_RES (3)..(3): Asn or Gln
  MOD_RES (4)..(4): Any amino acid
QXXXQ

SEQ ID NO: 206494 - protein, 3 aa, Artificial Sequence
  Description of Artificial Sequence: Synthetic peptide
  MOD_RES (2)..(2): Any aliphatic amino acid
SXS

SEQ ID NO: 206495 - protein, 5 aa, Artificial Sequence
  Description of Artificial Sequence: Synthetic peptide
  MOD_RES (2)..(2): Any amino acid
  MOD_RES (4)..(4): Any amino acid
PXLXT

SEQ ID NO: 206496 - protein, 5 aa, Artificial Sequence
  Description of Artificial Sequence: Synthetic peptide
PALKT

SEQ ID NO: 206497 - protein, 5 aa, Artificial Sequence
  Description of Artificial Sequence: Synthetic peptide
  MOD_RES (2)..(2): Any amino acid
  MOD_RES (4)..(4): Any amino acid
PXNXT

SEQ ID NO: 206498 - protein, 5 aa, Artificial Sequence
  Description of Artificial Sequence: Synthetic peptide
PSNST

SEQ ID NO: 206499 - protein, 5 aa, Artificial Sequence
  Description of Artificial Sequence: Synthetic peptide
PPNTT

SEQ ID NO: 206500 - protein, 6 aa, Artificial Sequence
  Description of Artificial Sequence: Synthetic peptide
  MOD_RES (2)..(4): Any amino acid
  MOD_RES (6)..(6): Any amino acid
PXXXTX

SEQ ID NO: 206501 - protein, 6 aa, Artificial Sequence
  Description of Artificial Sequence: Synthetic peptide
  MOD_RES (2)..(2): Any amino acid
  MOD_RES (4)..(4): Any amino acid
  MOD_RES (6)..(6): Any amino acid
PXLXTX

SEQ ID NO: 206502 - protein, 6 aa, Artificial Sequence
  Description of Artificial Sequence: Synthetic peptide
  MOD_RES (2)..(2): Any amino acid
  MOD_RES (4)..(4): Any amino acid
  MOD_RES (6)..(6): Any amino acid
PXNXTX

SEQ ID NO: 206503 - protein, 6 aa, Artificial Sequence
  Description of Artificial Sequence: Synthetic peptide
  MOD_RES (1)..(1): Any amino acid
  MOD_RES (3)..(5): Any amino acid
XPXXXT

SEQ ID NO: 206504 - protein, 7 aa, Artificial Sequence
  Description of Artificial Sequence: Synthetic peptide
  MOD_RES (1)..(1): Any amino acid
  MOD_RES (3)..(5): Any amino acid
  MOD_RES (7)..(7): Any amino acid
XPXXXTX

SEQ ID NO: 206505 - protein, 7 aa, Artificial Sequence
  Description of Artificial Sequence: Synthetic peptide
APSNSTA

SEQ ID NO: 206506 - protein, 7 aa, Artificial Sequence
  Description of Artificial Sequence: Synthetic peptide
SPALKTV

SEQ ID NO: 206507 - protein, 7 aa, Artificial Sequence
  Description of Artificial Sequence: Synthetic peptide
STPPNTT

SEQ ID NO: 206508 - protein, 4 aa, Artificial Sequence
  Description of Artificial Sequence: Synthetic peptide
PSNS

SEQ ID NO: 206509 - protein, 4 aa, Artificial Sequence
  Description of Artificial Sequence: Synthetic peptide
PSLS

SEQ ID NO: 206510 - protein, 5 aa, Artificial Sequence
  Description of Artificial Sequence: Synthetic peptide
  MOD_RES (1)..(1): Any amino acid
  MOD_RES (4)..(4): Any amino acid
XPSXS

SEQ ID NO: 206511 - protein, 5 aa, Artificial Sequence
  Description of Artificial Sequence: Synthetic peptide
APSNS

SEQ ID NO: 206512 - protein, 5 aa, Artificial Sequence
  Description of Artificial Sequence: Synthetic peptide
LPSLS

SEQ ID NO: 206513 - protein, 6 aa, Artificial Sequence
  Description of Artificial Sequence: Synthetic peptide
MLPSLS

SEQ ID NO: 206514 - protein, 7 aa, Artificial Sequence
  Description of Artificial Sequence: Synthetic peptide
PMLPSLS

SEQ ID NO: 206515 - protein, 7 aa, Artificial Sequence
  Description of Artificial Sequence: Synthetic peptide
SQKNPQM

SEQ ID NO: 206516 - protein, 7 aa, Artificial Sequence
  Description of Artificial Sequence: Synthetic peptide
FQSQYQK

SEQ ID NO: 206517 - protein, 7 aa, Artificial Sequence
  Description of Artificial Sequence: Synthetic peptide
MASISMK

SEQ ID NO: 206518 - protein, 7 aa, Artificial Sequence
  Description of Artificial Sequence: Synthetic peptide
DWWHTSA

SEQ ID NO: 206519 - protein, 7 aa, Artificial Sequence
  Description of Artificial Sequence: Synthetic peptide
SHVKLNS

SEQ ID NO: 206520 - protein, 7 aa, Artificial Sequence
  Description of Artificial Sequence: Synthetic peptide
QLLTGAS

SEQ ID NO: 206521 - protein, 7 aa, Artificial Sequence
  Description of Artificial Sequence: Synthetic peptide
TARDYRL

SEQ ID NO: 206522 - protein, 7 aa, Artificial Sequence
  Description of Artificial Sequence: Synthetic peptide
FPRAPHH

SEQ ID NO: 206523 - protein, 7 aa, Artificial Sequence
  Description of Artificial Sequence: Synthetic peptide
SEWLSAL

SEQ ID NO: 206524 - protein, 7 aa, Artificial Sequence
  Description of Artificial Sequence: Synthetic peptide
IGGIRRH

SEQ ID NO: 206525 - protein, 7 aa, Artificial Sequence
  Description of Artificial Sequence: Synthetic peptide
YTMEFNR

SEQ ID NO: 206526 - protein, 7 aa, Artificial Sequence
  Description of Artificial Sequence: Synthetic peptide
PAAYKAH

SEQ ID NO: 206527 - protein, 6 aa, Artificial Sequence
  Description of Artificial Sequence: Synthetic peptide
  MOD_RES (2)..(4): Any amino acid
  MOD_RES (6)..(6): Ala or Val
PXXXTX

SEQ ID NO: 206528 - protein, 5 aa, Artificial Sequence
  Description of Artificial Sequence: Synthetic peptide
  MOD_RES (2)..(2): Any amino acid
  MOD_RES (4)..(4): Any amino acid
PXNXT

SEQ ID NO: 206529 - protein, 5 aa, Artificial Sequence
  Description of Artificial Sequence: Synthetic peptide
  MOD_RES (2)..(2): Any amino acid
  MOD_RES (3)..(3): Asn or Leu
  MOD_RES (4)..(4): Any amino acid
PXXXT

SEQ ID NO: 206530 - protein, 5 aa, Artificial Sequence
  Description of Artificial Sequence: Synthetic peptide
  MOD_RES (2)..(2): Any amino acid
PXNNT

SEQ ID NO: 206531 - protein, 5 aa, Artificial Sequence
  Description of Artificial Sequence: Synthetic peptide
  MOD_RES (1)..(1): Ala or Leu
  MOD_RES (4)..(4): Any amino acid
XPSXS

SEQ ID NO: 206532 - protein, 5 aa, Artificial Sequence
  Description of Artificial Sequence: Synthetic peptide
  MOD_RES (2)..(2): Any amino acid
  MOD_RES (3)..(3): Asn or Gln
  MOD_RES (4)..(4): Any amino acid
QXXXQ

SEQ ID NO: 206533 - protein, 3 aa, Artificial Sequence
  Description of Artificial Sequence: Synthetic peptide
  MOD_RES (2)..(2): Leu or Ile
SXS

SEQ ID NO: 206534 - protein, 28 aa, Artificial Sequence
  Description of Artificial Sequence: Synthetic peptide
KKKKKKKKKKKKKKKKGACSHVKLNSCG

SEQ ID NO: 206535 - protein, 28 aa, Artificial Sequence
  Description of Artificial Sequence: Synthetic peptide
KKKKKKKKKKKKKKKKGACAPSNSTACG

SEQ ID NO: 206536 - protein, 28 aa, Artificial Sequence
  Description of Artificial Sequence: Synthetic peptide
KKKKKKKKKKKKKKKKGACFPRAPHHCG

SEQ ID NO: 206537 - protein, 28 aa, Artificial Sequence
  Description of Artificial Sequence: Synthetic peptide
KKKKKKKKKKKKKKKKGACDWWHTSACG

SEQ ID NO: 206538 - protein, 27 aa, Artificial Sequence
  Description of Artificial Sequence: Synthetic peptide
KKKKKKKKKKKKKKKKGACRREEWACG

SEQ ID NO: 206539 - protein, 28 aa, Artificial Sequence
  Description of Artificial Sequence: Synthetic peptide
KKKKKKKKKKKKKKKKGACMASISMKCQ

SEQ ID NO: 206540 - protein, 26 aa, Artificial Sequence
  Description of Artificial Sequence: Synthetic peptide
GIGAVLKVLTTGLPALISWIKRKRQQ

SEQ ID NO: 206541 - protein, 26 aa, Artificial Sequence
  Description of Artificial Sequence: Synthetic peptide
GIGAILKVLATGLPTLISWIKNKRKQ

SEQ ID NO: 206542 - protein, 26 aa, Artificial Sequence
  Description of Artificial Sequence: Synthetic peptide
AIGAILKVLATGLPTLISWIKNKRKQ

SEQ ID NO: 206543 - protein, 26 aa, Artificial Sequence
  Description of Artificial Sequence: Synthetic peptide
CIGAILKVLATGLPTLISWIKNKRKQ

SEQ ID NO: 206544 - protein, 26 aa, Artificial Sequence
  Description of Artificial Sequence: Synthetic peptide
FIGAILKVLATGLPTLISWIKNKRKQ

SEQ ID NO: 206545 - protein, 26 aa, Artificial Sequence
  Description of Artificial Sequence: Synthetic peptide
HIGAILKVLATGLPTLISWIKNKRKQ

SEQ ID NO: 206546 - protein, 26 aa, Artificial Sequence
  Description of Artificial Sequence: Synthetic peptide
IIGAILKVLATGLPTLISWIKNKRKQ

SEQ ID NO: 206547 - protein, 26 aa, Artificial Sequence
  Description of Artificial Sequence: Synthetic peptide
LIGAILKVLATGLPTLISWIKNKRKQ

SEQ ID NO: 206548 - protein, 28 aa, Artificial Sequence
  Description of Artificial Sequence: Synthetic peptide
NLEIGAILKVLATGLPTLISWIKNKRKQ

SEQ ID NO: 206549 - protein, 26 aa, Artificial Sequence
  Description of Artificial Sequence: Synthetic peptide
VIGAILKVLATGLPTLISWIKNKRKQ

SEQ ID NO: 206550 - protein, 26 aa, Artificial Sequence
  Description of Artificial Sequence: Synthetic peptide
WIGAILKVLATGLPTLISWIKNKRKQ

SEQ ID NO: 206551 - protein, 26 aa, Artificial Sequence
  Description of Artificial Sequence: Synthetic peptide
YIGAILKVLATGLPTLISWIKNKRKQ

SEQ ID NO: 206552 - protein, 26 aa, Artificial Sequence
  Description of Artificial Sequence: Synthetic peptide
GIGAILKVLACGLPTLISWIKNKRKQ

SEQ ID NO: 206553 - protein, 26 aa, Artificial Sequence
  Description of Artificial Sequence: Synthetic peptide
GIGAILKVLATLLPTLISWIKNKRKQ

SEQ ID NO: 206554 - protein, 26 aa, Artificial Sequence
  Description of Artificial Sequence: Synthetic peptide
GIGAILKVLATWLPTLISWIKNKRKQ

SEQ ID NO: 206555 - protein, 26 aa, Artificial Sequence
  Description of Artificial Sequence: Synthetic peptide
GIGAILKVLATGLPTLISWIKTKRKQ

SEQ ID NO: 206556 - protein, 26 aa, Artificial Sequence
  Description of Artificial Sequence: Synthetic peptide
YIGAILNVLATGLPTLISWIKNKRKQ

SEQ ID NO: 206557 - protein, 26 aa, Artificial Sequence
  Description of Artificial Sequence: Synthetic peptide
YIGAILAVLATGLPTLISWIKNKRKQ

SEQ ID NO: 206558 - protein, 26 aa, Artificial Sequence
  Description of Artificial Sequence: Synthetic peptide
LIGAILSVLATGLPTLISWIKNKRKQ

SEQ ID NO: 206559 - protein, 26 aa, Artificial Sequence
  Description of Artificial Sequence: Synthetic peptide
LIGAILRVLATGLPTLISWIKNKRKQ

SEQ ID NO: 206560 - protein, 26 aa, Artificial Sequence
  Description of Artificial Sequence: Synthetic peptide
LIGAILHVLATGLPTLISWIKNKRKQ

SEQ ID NO: 206561 - protein, 26 aa, Artificial Sequence
  Description of Artificial Sequence: Synthetic peptide
LIGAILKVLACGLPTLISWIKNKRKQ

SEQ ID NO: 206562 - protein, 27 aa, Artificial Sequence
  Description of Artificial Sequence: Synthetic peptide
GIGAVLKVLTTGLPALISWISRKKRQQ

SEQ ID NO: 206563 - protein, 25 aa, Artificial Sequence
  Description of Artificial Sequence: Synthetic peptide
GIGARLKVLTTGLPRISWIKRKRQQ

SEQ ID NO: 206564 - protein, 26 aa, Artificial Sequence
  Description of Artificial Sequence: Synthetic peptide
GIGAILKVLSTGLPALISWIKRKRQE

SEQ ID NO: 206565 - protein, 26 aa, Artificial Sequence
  Description of Artificial Sequence: Synthetic peptide
GIGAVLKVLTTGLPALIGWIKRKRQQ

SEQ ID NO: 206566 - protein, 26 aa, Artificial Sequence
  Description of Artificial Sequence: Synthetic peptide
GIGAVLKVLATGLPALISWIKRKRQQ

SEQ ID NO: 206567 - protein, 26 aa, Artificial Sequence
  Description of Artificial Sequence: Synthetic peptide
GIGAVLKVLSTGLPALISWIKRKRQQ

SEQ ID NO: 206568 - protein, 26 aa, Artificial Sequence
  Description of Artificial Sequence: Synthetic peptide
GIGAILRVLATGLPTLISWIKNKRKQ

SEQ ID NO: 206569 - protein, 26 aa, Artificial Sequence
  Description of Artificial Sequence: Synthetic peptide
GIGAILKVLATGLPTLISWIKRKRKQ

SEQ ID NO: 206570 - protein, 26 aa, Artificial Sequence
  Description of Artificial Sequence: Synthetic peptide
GIGAILKVLATGLPTLISWIKKKKQQ

SEQ ID NO: 206571 - protein, 32 aa, Artificial Sequence
  Description of Artificial Sequence: Synthetic polypeptide
GIGAILKVLATGLPTLISWIKNKRKQGSKKKK

SEQ ID NO: 206572 - protein, 28 aa, Artificial Sequence
  Description of Artificial Sequence: Synthetic peptide
KKGIGAILKVLATGLPTLISWIKNKRKQ

SEQ ID NO: 206573 - protein, 26 aa, Artificial Sequence
  Description of Artificial Sequence: Synthetic peptide
GIGAILEVLATGLPTLISWIKNKRKQ

SEQ ID NO: 206574 - protein, 24 aa, Artificial Sequence
  Description of Artificial Sequence: Synthetic peptide
GIGAVLKVLTTGLPALISWIKRKR

SEQ ID NO: 206575 - protein, 22 aa, Artificial Sequence
  Description of Artificial Sequence: Synthetic peptide
GIGAVLKVLTTGLPALISWIKR

SEQ ID NO: 206576 - protein, 26 aa, Artificial Sequence
  Description of Artificial Sequence: Synthetic peptide
CIGAVLKVLTTGLPALISWIKRKRQQ

SEQ ID NO: 206577 - protein, 26 aa, Artificial Sequence
  Description of Artificial Sequence: Synthetic peptide
QQRKRKIWSILAPLGTTLVKLVAGIC

SEQ ID NO: 206578 - protein, 26 aa, Artificial Sequence
  Description of Artificial Sequence: Synthetic peptide
QQKKKKIWSILAPLGTTLVKLVAGIC

SEQ ID NO: 206579 - protein, 26 aa, Artificial Sequence
  Description of Artificial Sequence: Synthetic peptide
QKRKNKIWSILTPLGTALVKLIAGIG

SEQ ID NO: 206580 - protein, 26 aa, Artificial Sequence
  Description of Artificial Sequence: Synthetic peptide
QQRKRKIWSILAALGTTLVKLVAGIC

SEQ ID NO: 206581 - protein, 26 aa, Artificial Sequence
  Description of Artificial Sequence: Synthetic peptide
QKRKNKIWSILTPLGTALVKLIAGIG

SEQ ID NO: 206582 - protein, 23 aa, Artificial Sequence
  Description of Artificial Sequence: Synthetic peptide
  MOD_RES (3)..(3): Trp, Phe or Tyr
  MOD_RES (7)..(7): Trp, Phe or Tyr
  MOD_RES (10)..(10): Ala, Leu or Gly
  MISC_FEATURE (12)..(12): May or may not be present
  MOD_RES (16)..(16): Trp, Phe or Tyr
  MOD_RES (18)..(18): Arg or Lys
  MOD_RES (19)..(19): Lys, Leu or Ser
  MOD_RES (20)..(20): Leu or Lys
  MOD_RES (21)..(21): Arg or Trp
  MOD_RES (22)..(22): Lys or Ser
  MOD_RES (23)..(23): Ala, Val or Gln
GLXWRAXWRXLWRSLXWXXXXXX

SEQ ID NO: 206583 - protein, 20 aa, Artificial Sequence
  Description of Artificial Sequence: Synthetic peptide
GLWRALWRLLRSLWRLLWKA

SEQ ID NO: 206584 - protein, 21 aa, Artificial Sequence
  Description of Artificial Sequence: Synthetic peptide
GLWRALWRALWRSLWKLKRKV

SEQ ID NO: 206585 - protein, 20 aa, Artificial Sequence
  Description of Artificial Sequence: Synthetic peptide
GLWRALWRALRSLWKLKRKV

SEQ ID NO: 206586 - protein, 20 aa, Artificial Sequence
  Description of Artificial Sequence: Synthetic peptide
GLWRALWRGLRSLWKLKRKV

SEQ ID NO: 206587 - protein, 20 aa, Artificial Sequence
  Description of Artificial Sequence: Synthetic peptide
GLWRALWRGLRSLWKKKRKV

SEQ ID NO: 206588 - protein, 20 aa, Artificial Sequence
  Description of Artificial Sequence: Synthetic peptide
GLWRALWRLLRSLWRLLWKA

SEQ ID NO: 206589 - protein, 21 aa, Artificial Sequence
  Description of Artificial Sequence: Synthetic peptide
GLWRALWRALWRSLWKLKWKV

SEQ ID NO: 206590 - protein, 21 aa, Artificial Sequence
  Description of Artificial Sequence: Synthetic peptide
GLWRALWRALWRSLWKSKRKV

SEQ ID NO: 206591 - protein, 21 aa, Artificial Sequence
  Description of Artificial Sequence: Synthetic peptide
GLWRALWRALWRSLWKKKRKV

SEQ ID NO: 206592 - protein, 20 aa, Artificial Sequence
  Description of Artificial Sequence: Synthetic peptide
GLWRALWRLLRSLWRLLWSQ

SEQ ID NO: 206593 - protein, 27 aa, Artificial Sequence
  Description of Artificial Sequence: Synthetic peptide
GLWRALWRLLRSLWRLLWSQPKKKRKV

SEQ ID NO: 206594 - protein, 19 aa, Artificial Sequence
  Description of Artificial Sequence: Synthetic peptide
  MOD_RES (2)..(2): Beta-Ala
CXGLWRALWRLLRSLWRLL

SEQ ID NO: 206595 - protein, 10 aa, Artificial Sequence
  Description of Artificial Sequence: Synthetic peptide
  MOD_RES (1)..(1): Cha
  MOD_RES (4)..(4): Cha
  MOD_RES (7)..(7): Cha
  MOD_RES (10)..(10): Cha
XCCXCCXCCX

SEQ ID NO: 206596 - protein, 20 aa, Artificial Sequence
  Description of Artificial Sequence: Synthetic peptide
  MOD_RES (11)..(11): Cha
  MOD_RES (14)..(14): Cha
  MOD_RES (17)..(17): Cha
  MOD_RES (20)..(20): Cha
GSESGGSESGXCCXCCXCCX

SEQ ID NO: 206597 - protein, 20 aa, Artificial Sequence
  Description of Artificial Sequence: Synthetic peptide
  MOD_RES (11)..(11): Cha
  MOD_RES (14)..(14): Cha
  MOD_RES (17)..(17): Cha
  MOD_RES (20)..(20): Cha
GSSSGGSSSGXCCXCCXCCX

SEQ ID NO: 206598 - protein, 29 aa, Artificial Sequence
  Description of Artificial Sequence: Synthetic peptide
  MOD_RES (20)..(20): Cha
  MOD_RES (23)..(23): Cha
  MOD_RES (26)..(26): Cha
  MOD_RES (29)..(29): Cha
GPKKKRKVGGSESGGSESGXCCXCCXCCX

SEQ ID NO: 206599 - protein, 21 aa, Artificial Sequence
  Description of Artificial Sequence: Synthetic peptide
  MOD_RES (12)..(12): Cha
  MOD_RES (15)..(15): Cha
  MOD_RES (18)..(18): Cha
  MOD_RES (21)..(21): Cha
KGSESGGSESGXCCXCCXCCX

SEQ ID NO: 206600 - protein, 6 aa, Artificial Sequence
  Description of Artificial Sequence: Synthetic peptide
CCVVVT

SEQ ID NO: 206601 - protein, 9 aa, Artificial Sequence
  Description of Artificial Sequence: Synthetic peptide
CCVVVTRGD

SEQ ID NO: 206602 - protein, 9 aa, Artificial Sequence
  Description of Artificial Sequence: Synthetic peptide
CCVVVTRGD

SEQ ID NO: 206603 - protein, 6 aa, Artificial Sequence
  Description of Artificial Sequence: Synthetic peptide
CCVVVT

SEQ ID NO: 206604 - protein, 15 aa, Artificial Sequence
  Description of Artificial Sequence: Synthetic peptide
CCVVVTGRGDSPSSK

SEQ ID NO: 206605 - protein, 5 aa, Artificial Sequence
  Description of Artificial Sequence: Synthetic peptide
CRPPR

SEQ ID NO: 206606 - protein, 5 aa, Artificial Sequence
  Description of Artificial Sequence: Synthetic peptide
CPPRR

SEQ ID NO: 206607 - protein, 5 aa, Artificial Sequence
  Description of Artificial Sequence: Synthetic peptide
CRRRR

SEQ ID NO: 206608 - protein, 6 aa, Artificial Sequence
  Description of Artificial Sequence: Synthetic peptide
CARPAR

SEQ ID NO: 206609 - protein, 6 aa, Artificial Sequence
  Description of Artificial Sequence: Synthetic peptide
CPKRPR

SEQ ID NO: 206610 - protein, 6 aa, Artificial Sequence
  Description of Artificial Sequence: Synthetic peptide
  MOD_RES (4)..(4): Tyr(OMe)
RGDYKE

SEQ ID NO: 206611 - protein, 5 aa, Artificial Sequence
  Description of Artificial Sequence: Synthetic peptide
CRRPP

SEQ ID NO: 206612 - protein, 5 aa, Artificial Sequence
  Description of Artificial Sequence: Synthetic peptide
CRPPR

SEQ ID NO: 206613 - protein, 9 aa, Artificial Sequence
  Description of Artificial Sequence: Synthetic peptide
CGRKSKTVC

SEQ ID NO: 206614 - protein, 9 aa, Artificial Sequence
  Description of Artificial Sequence: Synthetic peptide
CGNQVDSRC

SEQ ID NO: 206615 - protein, 8 aa, Artificial Sequence
  Description of Artificial Sequence: Synthetic peptide
CPSELLLP

SEQ ID NO: 206616 - protein, 6 aa, Artificial Sequence
  Description of Artificial Sequence: Synthetic peptide
CARPAR

SEQ ID NO: 206617 - protein, 6 aa, Artificial Sequence
  Description of Artificial Sequence: Synthetic peptide
CPKRPR

SEQ ID NO: 206618 - protein, 6 aa, Artificial Sequence
  Description of Artificial Sequence: Synthetic peptide
CKRAVR

SEQ ID NO: 206619 - protein, 9 aa, Artificial Sequence
  Description of Artificial Sequence: Synthetic peptide
CRNSWKPNC

SEQ ID NO: 206620 - protein, 5 aa, Artificial Sequence
  Description of Artificial Sequence: Synthetic peptide
RGSSS

SEQ ID NO: 206621 - protein, 9 aa, Artificial Sequence
  Description of Artificial Sequence: Synthetic peptide
CLIDLHVMC

SEQ ID NO: 206622 - protein, 9 aa, Artificial Sequence
  Description of Artificial Sequence: Synthetic peptide
CRSTRANPC

SEQ ID NO: 206623 - protein, 9 aa, Artificial Sequence
  Description of Artificial Sequence: Synthetic peptide
CPKTRRVPC

SEQ ID NO: 206624 - protein, 9 aa, Artificial Sequence
  Description of Artificial Sequence: Synthetic peptide
CSGMARTKC

SEQ ID NO: 206625 - protein, 7 aa, Artificial Sequence
  Description of Artificial Sequence: Synthetic peptide
GRKSKTV

SEQ ID NO: 206626 - protein, 49 aa, Artificial Sequence
  Description of Artificial Sequence: Synthetic polypeptide
  MOD_RES (2)..(21): Any amino acid
  MISC_FEATURE (2)..(21): This region may encompass 0-20 residues
  MOD_RES (29)..(48): Any amino acid
  MISC_FEATURE (29)..(48): This region may encompass 0-20 residues
CXXXXXXXXXXXXXXXXXXXXGRKSKTVXXXXXXXXXXXXXXXXXXXXC

SEQ ID NO: 206627 - protein, 7 aa, Artificial Sequence
  Description of Artificial Sequence: Synthetic peptide
RNSWKPN

SEQ ID NO: 206628 - protein, 49 aa, Artificial Sequence
  Description of Artificial Sequence: Synthetic polypeptide
  MOD_RES (2)..(21): Any amino acid
  MISC_FEATURE (2)..(21): This region may encompass 0-20 residues
  MISC_FEATURE (29)..(48): Any amino acid
  MOD_RES (29)..(48): This region may encompass 0-20 residues
CXXXXXXXXXXXXXXXXXXXXRNSWKPNXXXXXXXXXXXXXXXXXXXXC

SEQ ID NO: 206629 - protein, 7 aa, Artificial Sequence
  Description of Artificial Sequence: Synthetic peptide
RSTRANP

SEQ ID NO: 206630 - protein, 49 aa, Artificial Sequence
  Description of Artificial Sequence: Synthetic polypeptide
  MOD_RES (2)..(21): Any amino acid
  MISC_FEATURE (2)..(21): This region may encompass 0-20 residues
  MOD_RES (29)..(48): Any amino acid
  MISC_FEATURE (29)..(48): This region may encompass 0-20 residues
CXXXXXXXXXXXXXXXXXXXXRSTRANPXXXXXXXXXXXXXXXXXXXXC

SEQ ID NO: 206631 - protein, 7 aa, Artificial Sequence
  Description of Artificial Sequence: Synthetic peptide
PKTRRVP

SEQ ID NO: 206632 - protein, 49 aa, Artificial Sequence
  Description of Artificial Sequence: Synthetic polypeptide
  MOD_RES (2)..(21): Any amino acid
  MISC_FEATURE (2)..(21): This region may encompass 0-20 residues
  MOD_RES (29)..(48): Any amino acid
  MISC_FEATURE (29)..(48): This region may encompass 0-20 residues
CXXXXXXXXXXXXXXXXXXXXPKTRRVPXXXXXXXXXXXXXXXXXXXXC

SEQ ID NO: 206633 - protein, 7 aa, Artificial Sequence
  Description of Artificial Sequence: Synthetic peptide
SGMARTK

SEQ ID NO: 206634 - protein, 49 aa, Artificial Sequence
  Description of Artificial Sequence: Synthetic polypeptide
  MOD_RES (2)..(21): Any amino acid
  MISC_FEATURE (2)..(21): This region may encompass 0-20 residues
  MOD_RES (29)..(48): Any amino acid
  MISC_FEATURE (29)..(48): This region may encompass 0-20 residues
CXXXXXXXXXXXXXXXXXXXXSGMARTKXXXXXXXXXXXXXXXXXXXXC

SEQ ID NO: 206635 - protein, 7 aa, Artificial Sequence
  Description of Artificial Sequence: Synthetic peptide
GGGVFWQ

SEQ ID NO: 206636 - protein, 7 aa, Artificial Sequence
  Description of Artificial Sequence: Synthetic peptide
HGRVRPH

SEQ ID NO: 206637 - protein, 7 aa, Artificial Sequence
  Description of Artificial Sequence: Synthetic peptide
VVLVTSS

SEQ ID NO: 206638 - protein, 8 aa, Artificial Sequence
  Description of Artificial Sequence: Synthetic peptide
CLHRGNSC

SEQ ID NO: 206639 - protein, 12 aa, Artificial Sequence
  Description of Artificial Sequence: Synthetic peptide
CRSWNKADNRSC

SEQ ID NO: 206640 - protein, 12 aa, Artificial Sequence
  Description of Artificial Sequence: Synthetic peptide
SVSVGMKPSPRP

SEQ ID NO: 206641 - protein, 12 aa, Artificial Sequence
  Description of Artificial Sequence: Synthetic peptide
GISLSSYLQSTQ

SEQ ID NO: 206642 - protein, 12 aa, Artificial Sequence
  Description of Artificial Sequence: Synthetic peptide
EHMALTYPFRPP

SEQ ID NO: 206643 - protein, 12 aa, Artificial Sequence
  Description of Artificial Sequence: Synthetic peptide
HWAPSMYDYVSW

SEQ ID NO: 206644 - protein, 12 aa, Artificial Sequence
  Description of Artificial Sequence: Synthetic peptide
RTVPDYTAHVRT

SEQ ID NO: 206645 - protein, 12 aa, Artificial Sequence
  Description of Artificial Sequence: Synthetic peptide
SGHQLLLNKMPN

SEQ ID NO: 206646 - protein, 12 aa, Artificial Sequence
  Description of Artificial Sequence: Synthetic peptide
TNSIWYTAPYMF

SEQ ID NO: 206647 - protein, 12 aa, Artificial Sequence
  Description of Artificial Sequence: Synthetic peptide
GMSLSRQMLWSL

SEQ ID NO: 206648 - protein, 12 aa, Artificial Sequence
  Description of Artificial Sequence: Synthetic peptide
HLFPQSNYGGHS

SEQ ID NO: 206649 - protein, 12 aa, Artificial Sequence
  Description of Artificial Sequence: Synthetic peptide
  MOD_RES (11)..(11): Any naturally occurring amino acid
CIQLANPPRLXG

SEQ ID NO: 206650 - protein, 12 aa, Artificial Sequence
  Description of Artificial Sequence: Synthetic peptide
PSPHRQRQHILR

SEQ ID NO: 206651 - protein, 12 aa, Artificial Sequence
  Description of Artificial Sequence: Synthetic peptide
QTIRIIIRRSRT

SEQ ID NO: 206652 - protein, 12 aa, Artificial Sequence
  Description of Artificial Sequence: Synthetic peptide
SLHMRHKRKPRR

SEQ ID NO: 206653 - protein, 11 aa, Artificial Sequence
  Description of Artificial Sequence: Synthetic peptide
SRSMQRTLIIS

SEQ ID NO: 206654 - protein, 12 aa, Artificial Sequence
  Description of Artificial Sequence: Synthetic peptide
IRSIRMRRILIL

SEQ ID NO: 206655 - protein, 12 aa, Artificial Sequence
  Description of Artificial Sequence: Synthetic peptide
KTSMRPLILIHI

SEQ ID NO: 206656 - protein, 7 aa, Artificial Sequence
  Description of Artificial Sequence: Synthetic peptide
TGSTQHQ

SEQ ID NO: 206657 - protein, 7 aa, Artificial Sequence
  Description of Artificial Sequence: Synthetic peptide
HSALTKH

SEQ ID NO: 206658 - protein, 7 aa, Artificial Sequence
  Description of Artificial Sequence: Synthetic peptide
KTGSHNQ

SEQ ID NO: 206659 - protein, 7 aa, Artificial Sequence
  Description of Artificial Sequence: Synthetic peptide
MGPSSML

SEQ ID NO: 206660 - protein, 7 aa, Artificial Sequence
  Description of Artificial Sequence: Synthetic peptide
TDPNQLQ

SEQ ID NO: 206661 - protein, 7 aa, Artificial Sequence
  Description of Artificial Sequence: Synthetic peptide
STHFIDT

SEQ ID NO: 206662 - protein, 9 aa, Artificial Sequence
  Description of Artificial Sequence: Synthetic peptide
CTGSTQHQC

SEQ ID NO: 206663 - protein, 9 aa, Artificial Sequence
  Description of Artificial Sequence: Synthetic peptide
CHSALTKHC

SEQ ID NO: 206664 - protein, 9 aa, Artificial Sequence
  Description of Artificial Sequence: Synthetic peptide
CKTGSHNQC

SEQ ID NO: 206665 - protein, 9 aa, Artificial Sequence
  Description of Artificial Sequence: Synthetic peptide
CMGPSSMLC

SEQ ID NO: 206666 - protein, 9 aa, Artificial Sequence
  Description of Artificial Sequence: Synthetic peptide
CTDPNQLQC

SEQ ID NO: 206667 - protein, 9 aa, Artificial Sequence
  Description of Artificial Sequence: Synthetic peptide
CSTHFIDTC

SEQ ID NO: 206668 - protein, 11 aa, Artificial Sequence
  Description of Artificial Sequence: Synthetic peptide
ACTGSTQHQCG

SEQ ID NO: 206669 - protein, 11 aa, Artificial Sequence
  Description of Artificial Sequence: Synthetic peptide
ACHSALTKHCG

SEQ ID NO: 206670 - protein, 11 aa, Artificial Sequence
  Description of Artificial Sequence: Synthetic peptide
ACKTGSHNQCG

SEQ ID NO: 206671 - protein, 11 aa, Artificial Sequence
  Description of Artificial Sequence: Synthetic peptide
ACMGPSSMLCG

SEQ ID NO: 206672 - protein, 11 aa, Artificial Sequence
  Description of Artificial Sequence: Synthetic peptide
ACTDPNQLQCG

SEQ ID NO: 206673 - protein, 11 aa, Artificial Sequence
  Description of Artificial Sequence: Synthetic peptide
ACSTHFIDTCG

SEQ ID NO: 206674 - protein, 31 aa, Artificial Sequence; identical to SEQ ID NO: 206417
  Description of Artificial Sequence: Synthetic polypeptide

SEQ ID NO: 206675 - protein, 9 aa, Artificial Sequence
  Description of Artificial Sequence: Synthetic peptide
CPRECESIC

SEQ ID NO: 206676 - protein, 31 aa, Artificial Sequence
  Description of Artificial Sequence: Synthetic polypeptide
CYNLCIRECESICGADGACWTWCADGCSRSC

SEQ ID NO: 206677 - protein, 13 aa, Artificial Sequence
  Description of Artificial Sequence: Synthetic peptide
CLGQCASICVNDC

SEQ ID NO: 206678 - protein, 13 aa, Artificial Sequence
  Description of Artificial Sequence: Synthetic peptide
CPKVCPRECESNC

SEQ ID NO: 206679 - protein, 13 aa, Artificial Sequence
  Description of Artificial Sequence: Synthetic peptide
CGTGCAVECEVVC

SEQ ID NO: 206680 - protein, 13 aa, Artificial Sequence
  Description of Artificial Sequence: Synthetic peptide
CAVACWADCQLGC

SEQ ID NO: 206681 - protein, 13 aa, Artificial Sequence
  Description of Artificial Sequence: Synthetic peptide
CSGLCTVQCEEGC

SEQ ID NO: 206682 - protein, 13 aa, Artificial Sequence
  Description of Artificial Sequence: Synthetic peptide
CSMMCEEGCDDWC

SEQ ID NO: 206683 - protein, 12 aa, Artificial Sequence
  Description of Artificial Sequence: Synthetic peptide
GGLCVPGLGGLC

SEQ ID NO: 206684 - protein, 12 aa, Artificial Sequence
  Description of Artificial Sequence: Synthetic peptide
LGGCVPGLGGLC

SEQ ID NO: 206685 - protein, 9 aa, Artificial Sequence
  Description of Artificial Sequence: Synthetic peptide
CGGLDVRMC

SEQ ID NO: 206686 - protein, 9 aa, Artificial Sequence
  Description of Artificial Sequence: Synthetic peptide
CDGGLDWVC

SEQ ID NO: 206687 - protein, 21 aa, Artificial Sequence
  Description of Artificial Sequence: Synthetic peptide
TRSSRAGLQFPVGRVHRLLRK

SEQ ID NO: 206688 - protein, 16 aa, Artificial Sequence
  Description of Artificial Sequence: Synthetic peptide
RKKRRRESRKKRRRES

SEQ ID NO: 206689 - protein, 15 aa, Artificial Sequence
  Description of Artificial Sequence: Synthetic peptide
GKRKKKGKLGKKRDP

SEQ ID NO: 206690 - protein, 15 aa, Artificial Sequence
  Description of Artificial Sequence: Synthetic peptide
GKRKKKGKLGKKRDP

SEQ ID NO: 206691 - protein, 17 aa, Artificial Sequence
  Description of Artificial Sequence: Synthetic peptide
GKRKKKGKLGKKRPRSR

SEQ ID NO: 206692 - protein, 18 aa, Artificial Sequence
  Description of Artificial Sequence: Synthetic peptide
RKKRRRESRRARRSPRHL

SEQ ID NO: 206693 - protein, 19 aa, Artificial Sequence
  Description of Artificial Sequence: Synthetic peptide
SRRARRSPRESGKKRKRKR

SEQ ID NO: 206694 - protein, 19 aa, Artificial Sequence
  Description of Artificial Sequence: Synthetic peptide
VKRGLKLRHVRPRVTRMDV

SEQ ID NO: 206695 - protein, 18 aa, Artificial Sequence
  Description of Artificial Sequence: Synthetic peptide
VKRGLKLRHVRPRVTRDV

SEQ ID NO: 206696 - protein, 14 aa, Artificial Sequence
  Description of Artificial Sequence: Synthetic peptide
SRRARRSPRHLGSG

SEQ ID NO: 206697 - protein, 16 aa, Artificial Sequence
  Description of Artificial Sequence: Synthetic peptide
LRRERQSRLRRERQSR

SEQ ID NO: 206698 - protein, 22 aa, Artificial Sequence
  Description of Artificial Sequence: Synthetic peptide
GAYDLRRRERQSRLRRRERQSR

SEQ ID NO: 206699 - protein, 30 aa, Artificial Sequence
  Description of Artificial Sequence: Synthetic polypeptide
WEAALAEALAEALAEHLAEALAEALEALAA

SEQ ID NO: 206700 - protein, 21 aa, Artificial Sequence
  Description of Artificial Sequence: Synthetic peptide
KGSWYSMRKMSMKIRPFFPQQ

SEQ ID NO: 206701 - protein, 20 aa, Artificial Sequence
  Description of Artificial Sequence: Synthetic peptide
KTRYYSMKKTTMKIIPFNRL

SEQ ID NO: 206702 - protein, 20 aa, Artificial Sequence
  Description of Artificial Sequence: Synthetic peptide
RGADYSLRAVRMKIRPLVTQ

SEQ ID NO: 206703 - protein, 24 aa, Artificial Sequence
  Description of Artificial Sequence: Synthetic peptide
LGTYTQDFNKFHTFPQTAIGVGAP

SEQ ID NO: 206704 - protein, 12 aa, Artificial Sequence
  Description of Artificial Sequence: Synthetic peptide
TSPLNIHNGQKL

SEQ ID NO: 206705 - protein, 12 aa, Artificial Sequence
  Description of Artificial Sequence: Synthetic peptide
NSAAFEDLRVLS

SEQ ID NO: 206706 - protein, 30 aa, Artificial Sequence
  Description of Artificial Sequence: Synthetic polypeptide
WEAKLAKALAKALAKHLAKALAKALKACEA

SEQ ID NO: 206707 - protein, 16 aa, Artificial Sequence
  Description of Artificial Sequence: Synthetic peptide
AAVALLPAVLLALLAP

SEQ ID NO: 206708 - protein, 10 aa, Artificial Sequence
  Description of Artificial Sequence: Synthetic peptide
VPMLKPMLKE

SEQ ID NO: 206709 - protein, 18 aa, Artificial Sequence
  Description of Artificial Sequence: Synthetic peptide
KLALKLALKALKAALKLA

SEQ ID NO: 206710 - protein, 27 aa, Artificial Sequence
  Description of Artificial Sequence: Synthetic peptide
GALFLGFLGAAGSTMGAWSQPKKKRKV

SEQ ID NO: 206711 - protein, 16 aa, Artificial Sequence
  Description of Artificial Sequence: Synthetic peptide
AAVALLPAVLLALLAP

SEQ ID NO: 206712 - protein, 9 aa, Artificial Sequence
  Description of Artificial Sequence: Synthetic peptide
VQRKRQKLM

SEQ ID NO: 206713 - protein, 15 aa, Artificial Sequence
  Description of Artificial Sequence: Synthetic peptide
SDLWEMMMVSLACQY

SEQ ID NO: 206714 - protein, 7 aa, Artificial Sequence
  Description of Artificial Sequence: Synthetic peptide
RRMKWKK

SEQ ID NO: 206715 - protein, 16 aa, Artificial Sequence
  Description of Artificial Sequence: Synthetic peptide
RVIRVWFQNKRCKDKK

SEQ ID NO: 206716 - protein, 28 aa, Artificial Sequence
  Description of Artificial Sequence: Synthetic peptide
MANLGYWLLALFVTMWTDVGLCKKRPKP

SEQ ID NO: 206717 - protein, 18 aa, Artificial Sequence
  Description of Artificial Sequence: Synthetic peptide
VRLPPPVRLPPPVRLPPP

SEQ ID NO: 206718 - protein, 7 aa, Artificial Sequence
  Description of Artificial Sequence: Synthetic peptide
PKKKRKV

SEQ ID NO: 206719 - protein, 17 aa, Artificial Sequence
  Description of Artificial Sequence: Synthetic peptide
AWSFRVSYRGISYRRSR

SEQ ID NO: 206720 - protein, 12 aa, Artificial Sequence
  Description of Artificial Sequence: Synthetic peptide
GWTLNSAGYLLG

SEQ ID NO: 206721 - protein, 14 aa, Artificial Sequence
  Description of Artificial Sequence: Synthetic peptide
INLKALAALAKKIL

SEQ ID NO: 206722 - protein, 34 aa, Artificial Sequence
  Description of Artificial Sequence: Synthetic polypeptide
DAATATRGRSAASRPTERPRAPARSASRPRRPVD

SEQ ID NO: 206723 - protein, 26 aa, Artificial Sequence
  Description of Artificial Sequence: Synthetic peptide
DPKGDPKGVTVTVTVTVTGKGDPKPD

SEQ ID NO: 206724 - protein, 6 aa, Artificial Sequence
  Description of Artificial Sequence: Synthetic peptide
ATKASK

SEQ ID NO: 206725 - protein, 7 aa, Artificial Sequence
  Description of Artificial Sequence: Synthetic peptide
ATKGATK

SEQ ID NO: 206726 - protein, 7 aa, Artificial Sequence
  Description of Artificial Sequence: Synthetic peptide
IAKAFKN

SEQ ID NO: 206727 - protein, 14 aa, Artificial Sequence
  Description of Artificial Sequence: Synthetic peptide
VRGSPAINVAVHVF

SEQ ID NO: 206728 - protein, 18 aa, Artificial Sequence
  Description of Artificial Sequence: Synthetic peptide
GSTSGSGKPGSGEGSTKG

SEQ ID NO: 206729 - protein, 18 aa, Artificial Sequence
  Description of Artificial Sequence: Synthetic peptide
KESGSVSSEQLAQFRSLD

SEQ ID NO: 206730 - protein, 4 aa, Artificial Sequence
  Description of Artificial Sequence: Synthetic peptide
GFLG

SEQ ID NO: 206731 - protein, 6 aa, Artificial Sequence
  Description of Artificial Sequence: Synthetic peptide
PLGLWA

SEQ ID NO: 206732 - protein, 6 aa, Artificial Sequence
  Description of Artificial Sequence: Synthetic peptide
RVLAEA

SEQ ID NO: 206733 - protein, 8 aa, Artificial Sequence
  Description of Artificial Sequence: Synthetic peptide
GGIEGRGS

SEQ ID NO: 206734 - protein, 9 aa, Artificial Sequence
  Description of Artificial Sequence: Synthetic peptide
RRRRRRRRR

SEQ ID NO: 206735 - protein, 10 aa, Artificial Sequence
  Description of Artificial Sequence: Synthetic peptide
EDVVCCSMSY

SEQ ID NO: 206736 - protein, 10 aa, Artificial Sequence
  Description of Artificial Sequence: Synthetic peptide
TRHRQPRGWE

SEQ ID NO: 206737 - protein, 10 aa, Artificial Sequence
  Description of Artificial Sequence: Synthetic peptide
AGNRVRRSVG

SEQ ID NO: 206738 - protein, 12 aa, Artificial Sequence
  Description of Artificial Sequence: Synthetic peptide
CRRRRRREAEAC

SEQ ID NO: 206739 - protein, 17 aa, Artificial Sequence
  Description of Artificial Sequence: Synthetic peptide
VSQTSKLTRAETVFPDV

SEQ ID NO: 206740 - protein, 20 aa, Artificial Sequence
  Description of Artificial Sequence: Synthetic peptide
LEAGCKNFFPRSFTSCGSLE

SEQ ID NO: 206741 - protein, 4 aa, Artificial Sequence
  Description of Artificial Sequence: Synthetic peptide
GGGS

SEQ ID NO: 206742 - protein, 4 aa, Artificial Sequence
  Description of Artificial Sequence: Synthetic peptide
GGGG

SEQ ID NO: 206743 - protein, 5 aa, Artificial Sequence
  Description of Artificial Sequence: Synthetic peptide
GGGGS

SEQ ID NO: 206744 - protein, 6 aa, Artificial Sequence
  Description of Artificial Sequence: Synthetic peptide
GGGGGG

SEQ ID NO: 206745 - protein, 8 aa, Artificial Sequence
  Description of Artificial Sequence: Synthetic peptide
GGGGGGGG

SEQ ID NO: 206746 - protein, 10 aa, Artificial Sequence
  Description of Artificial Sequence: Synthetic peptide
GGGGSGGGGS

SEQ ID NO: 206747 - protein, 12 aa, Artificial Sequence
  Description of Artificial Sequence: Synthetic peptide
GSAGSAAGSGEF

SEQ ID NO: 206748 - protein, 14 aa, Artificial Sequence
  Description of Artificial Sequence: Synthetic peptide
EGKSSGSGSESKST

SEQ ID NO: 206749 - protein, 15 aa, Artificial Sequence
  Description of Artificial Sequence: Synthetic peptide
GGGGSGGGGSGGGGS

SEQ ID NO: 206750 - protein, 18 aa, Artificial Sequence
  Description of Artificial Sequence: Synthetic peptide
KESGSVSSEQLAQFRSLD

SEQ ID NO: 206751 - protein, 20 aa, Artificial Sequence
  Description of Artificial Sequence: Synthetic peptide
NSGAGSGGSSGSDGASGSRD

SEQ ID NO: 206752 - protein, 20 aa, Artificial Sequence
  Description of Artificial Sequence: Synthetic peptide
GGGGSGGGGSGGGGSGGGGS

SEQ ID NO: 206753 - protein, 36 aa, Artificial Sequence
  Description of Artificial Sequence: Synthetic polypeptide
GGSGGGSEGGGSEGGGSEGGGSEGGGSEGGGSGGGS

SEQ ID NO: 206754 - protein, 36 aa, Artificial Sequence
  Description of Artificial Sequence: Synthetic polypeptide
GGSAGGSGSGSSGGSSGASGTGTAGGTGSGSGTGSG

SEQ ID NO: 206755 - protein, 5 aa, Artificial Sequence
  Description of Artificial Sequence: Synthetic peptide
PAPAP

SEQ ID NO: 206756 - protein, 10 aa, Artificial Sequence
  Description of Artificial Sequence: Synthetic peptide
APAPAPAPAP

SEQ ID NO: 206757 - protein, 12 aa, Artificial Sequence
  Description of Artificial Sequence: Synthetic peptide
APAPAPAPAPAP

SEQ ID NO: 206758 - protein, 14 aa, Artificial Sequence
  Description of Artificial Sequence: Synthetic peptide
APAPAPAPAPAPAP

SEQ ID NO: 206759 - protein, 16 aa, Artificial Sequence
  Description of Artificial Sequence: Synthetic peptide
APAPAPAPAPAPAPAP

SEQ ID NO: 206760 - protein, 18 aa, Artificial Sequence
  Description of Artificial Sequence: Synthetic peptide
APAPAPAPAPAPAPAPAP

SEQ ID NO: 206761 - protein, 20 aa, Artificial Sequence
  Description of Artificial Sequence: Synthetic peptide
APAPAPAPAPAPAPAPAPAP

SEQ ID NO: 206762 - protein, 22 aa, Artificial Sequence
  Description of Artificial Sequence: Synthetic peptide
APAPAPAPAPAPAPAPAPAPAP

SEQ ID NO: 206763 - protein, 24 aa, Artificial Sequence
  Description of Artificial Sequence: Synthetic peptide
APAPAPAPAPAPAPAPAPAPAPAP

SEQ ID NO: 206764 - protein, 26 aa, Artificial Sequence
  Description of Artificial Sequence: Synthetic peptide
APAPAPAPAPAPAPAPAPAPAPAPAP

SEQ ID NO: 206765 - protein, 28 aa, Artificial Sequence
  Description of Artificial Sequence: Synthetic peptide
APAPAPAPAPAPAPAPAPAPAPAPAPAP

SEQ ID NO: 206766 - protein, 30 aa, Artificial Sequence
  Description of Artificial Sequence: Synthetic polypeptide
APAPAPAPAPAPAPAPAPAPAPAPAPAPAP

SEQ ID NO: 206767 - protein, 32 aa, Artificial Sequence
  Description of Artificial Sequence: Synthetic polypeptide
APAPAPAPAPAPAPAPAPAPAPAPAPAPAPAP

SEQ ID NO: 206768 - protein, 33 aa, Artificial Sequence
  Description of Artificial Sequence: Synthetic polypeptide
EPEPEPEPIPEPPKEAPVVIEKPKPKPKPKPKP

SEQ ID NO: 206769 - protein, 34 aa, Artificial Sequence
  Description of Artificial Sequence: Synthetic polypeptide
APAPAPAPAPAPAPAPAPAPAPAPAPAPAPAPAP

SEQ ID NO: 206770 - protein, 5 aa, Artificial Sequence
  Description of Artificial Sequence: Synthetic peptide
EAAAK

SEQ ID NO: 206771 - protein, 10 aa, Artificial Sequence
  Description of Artificial Sequence: Synthetic peptide
EAAAKEAAAK

SEQ ID NO: 206772 - protein, 12 aa, Artificial Sequence
  Description of Artificial Sequence: Synthetic peptide
AEAAAKEAAAKA

SEQ ID NO: 206773 - protein, 15 aa, Artificial Sequence
  Description of Artificial Sequence: Synthetic peptide
EAAAKEAAAKEAAAK

SEQ ID NO: 206774 - protein, 17 aa, Artificial Sequence
  Description of Artificial Sequence: Synthetic peptide
AEAAAKEAAAKEAAAKA

SEQ ID NO: 206775 - protein, 22 aa, Artificial Sequence
  Description of Artificial Sequence: Synthetic peptide
AEAAAKEAAAKEAAAKEAAAKA

SEQ ID NO: 206776 - protein, 27 aa, Artificial Sequence
  Description of Artificial Sequence: Synthetic peptide
AEAAAKEAAAKEAAAKEAAAKEAAAKA

SEQ ID NO: 206777 - protein, 46 aa, Artificial Sequence
  Description of Artificial Sequence: Synthetic polypeptide
AEAAAKEAAAKEAAAKEAAAKALEAEAAAKEAAAKEAAAKEAAAKA

SEQ ID NO: 206778 - protein, 5 aa, Artificial Sequence
  Description of Artificial Sequence: Synthetic peptide
SSSSG

SEQ ID NO: 206779 - protein, 10 aa, Artificial Sequence
  Description of Artificial Sequence: Synthetic peptide
SSSSGSSSSG

SEQ ID NO: 206780 - protein, 13 aa, Artificial Sequence
  Description of Artificial Sequence: Synthetic peptide
SGSSSSGSSSSGS

SEQ ID NO: 206781 - protein, 15 aa, Artificial Sequence
  Description of Artificial Sequence: Synthetic peptide
SSSSGSSSSGSSSSG

SEQ ID NO: 206782 - protein, 19 aa, Artificial Sequence
  Description of Artificial Sequence: Synthetic peptide
SVTVSSSGSSSSGSSSSGS

SEQ ID NO: 206783 - protein, 20 aa, Artificial Sequence
  Description of Artificial Sequence: Synthetic peptide
SSSSGSSSSGSSSSGSSSSG

SEQ ID NO: 206784 - protein, 25 aa, Artificial Sequence
  Description of Artificial Sequence: Synthetic peptide
SSSSGSSSSGSSSSGSSSSGSSSSG

SEQ ID NO: 206785 - protein, 8 aa, Unknown
  Description of Unknown: mammalian sequence
LWSLDTTP

SEQ ID NO: 206786 - protein, 4 aa, Unknown
  Description of Unknown: mammalian sequence
MDGA

SEQ ID NO: 206787 - protein, 4 aa, Unknown
  Description of Unknown: mammalian sequence
QGNY

SEQ ID NO: 206788 - protein, 4 aa, Unknown
  Description of Unknown: mammalian sequence
RDGK

SEQ ID NO: 206789 - protein, 5 aa, Unknown
  Description of Unknown: mammalian sequence
DLNVG

SEQ ID NO: 206790 - protein, 5 aa, Unknown
  Description of Unknown: mammalian sequence
MATDE

SEQ ID NO: 206791 - protein, 6 aa, Unknown
  Description of Unknown: mammalian sequence
LTGSGA

SEQ ID NO: 206792 - protein, 7 aa, Unknown
  Description of Unknown: mammalian sequence
FAASGEL

SEQ ID NO: 206793 - protein, 7 aa, Unknown
  Description of Unknown: mammalian sequence
FNNREEQ

SEQ ID NO: 206794 - protein, 7 aa, Unknown
  Description of Unknown: mammalian sequence
GYMARNE

SEQ ID NO: 206795 - protein, 7 aa, Unknown
  Description of Unknown: mammalian sequence
VGTEHAK

SEQ ID NO: 206796 - protein, 5 aa, Unknown
  Description of Unknown: mammalian sequence
LNLDY

SEQ ID NO: 206797 - protein, 14 aa, Unknown
  Description of Unknown: mammalian sequence
KDGVIKGYYAYINP

SEQ ID NO: 206798 - protein, 4 aa, Unknown
  Description of Unknown: mammalian sequence
SKAQ

SEQ ID NO: 206799 - protein, 6 aa, Unknown
  Description of Unknown: mammalian sequence
LFNASA

SEQ ID NO: 206800 - protein, 6 aa, Unknown
  Description of Unknown: mammalian sequence
YQDGSV

SEQ ID NO: 206801 - protein, 7 aa, Unknown
  Description of Unknown: mammalian sequence
IHPQSVI

SEQ ID NO: 206802 - protein, 5 aa, Unknown
  Description of Unknown: mammalian sequence
KNPMD

SEQ ID NO: 206803 - protein, 7 aa, Unknown
  Description of Unknown: mammalian sequence
LGSEVPL

SEQ ID NO: 206804 - protein, 14 aa, Unknown
  Description of Unknown: mammalian sequence
LNVNNKVPNGATSM

SEQ ID NO: 206805 - protein, 5 aa, Unknown
  Description of Unknown: mammalian sequence
TTDDL

SEQ ID NO: 206806 - protein, 6 aa, Unknown
  Description of Unknown: mammalian sequence
AAGIRA

SEQ ID NO: 206807 - protein, 6 aa, Unknown
  Description of Unknown: mammalian sequence
QAGVDC

SEQ ID NO: 206808 - protein, 6 aa, Unknown
  Description of Unknown: mammalian sequence
YNPTDI

SEQ ID NO: 206809 - protein, 8 aa, Unknown
  Description of Unknown: mammalian sequence
EFLPRDTG

SEQ ID NO: 206810 - protein, 9 aa, Unknown
  Description of Unknown: mammalian sequence
GSGLPEQTD

SEQ ID NO: 206811 - protein, 5 aa, Unknown
  Description of Unknown: mammalian sequence
YSSNV

SEQ ID NO: 206812 - protein, 6 aa, Unknown
  Description of Unknown: mammalian sequence
KAGLNP

SEQ ID NO: 206813 - protein, 6 aa, Unknown
  Description of Unknown: mammalian sequence
KEEGKF

SEQ ID NO: 206814 - protein, 6 aa, Unknown
  Description of Unknown: mammalian sequence
VRGGIW

SEQ ID NO: 206815 - protein, 9 aa, Unknown
  Description of Unknown: mammalian sequence
QRYLKPENK

SEQ ID NO: 206816 - protein, 6 aa, Unknown
  Description of Unknown: mammalian sequence
EGVGEI

SEQ ID NO: 206817 - protein, 8 aa, Unknown
  Description of Unknown: mammalian sequence
PVDPPEKW

SEQ ID NO: 206818 - protein, 9 aa, Unknown
  Description of Unknown: mammalian sequence
AHPGVSIPT

SEQ ID NO: 206819 - protein, 15 aa, Unknown
  Description of Unknown: mammalian sequence
FKDPELPRNTPKRSI

SEQ ID NO: 206820 - protein, 14 aa, Unknown
  Description of Unknown: mammalian sequence
YLEGVERNPVGAGL

SEQ ID NO: 206821 - protein, 5 aa, Unknown
  Description of Unknown: mammalian sequence
CPRCP

SEQ ID NO: 206822 - protein, 7 aa, Unknown
  Description of Unknown: mammalian sequence
APPVAGP

SEQ ID NO: 206823 - protein, 8 aa, Unknown
  Description of Unknown: mammalian sequence
APELLGGP

SEQ ID NO: 206824 - protein, 9 aa, Unknown
  Description of Unknown: mammalian sequence
CCVECPPCP

SEQ ID NO: 206825 - protein, 12 aa, Unknown
  Description of Unknown: mammalian sequence
ELKTPLGDTTHT

SEQ ID NO: 206826 - protein, 6 aa, Unknown
  Description of Unknown: mammalian sequence
HNVDDV

SEQ ID NO: 206827 - protein, 6 aa, Unknown
  Description of Unknown: mammalian sequence
AGQKDE

SEQ ID NO: 206828 - protein, 9 aa, Unknown
  Description of Unknown: mammalian sequence
KLNLPILPT

SEQ ID NO: 206829 - protein, 9 aa, Unknown
  Description of Unknown: mammalian sequence
SSPRVTNEG

SEQ ID NO: 206830 - protein, 17 aa, Unknown
  Description of Unknown: mammalian sequence
KAAAALKGSDHRRATNV

SEQ ID NO: 206831 - protein, 4 aa, Unknown
  Description of Unknown: mammalian sequence
KKRV

SEQ ID NO: 206832 - protein, 5 aa, Unknown
  Description of Unknown: mammalian sequence
QLEVK

SEQ ID NO: 206833 - protein, 5 aa, Unknown
  Description of Unknown: mammalian sequence
TNGRL

SEQ ID NO: 206834 - protein, 10 aa, Unknown
  Description of Unknown: mammalian sequence
LYTPEIAENQ

SEQ ID NO: 206835 - protein, 4 aa, Unknown
  Description of Unknown: mammalian sequence
NSEY

SEQ ID NO: 206836 - protein, 5 aa, Unknown
  Description of Unknown: mammalian sequence
SMKDF

SEQ ID NO: 206837 - protein, 12 aa, Unknown
  Description of Unknown: mammalian sequence
KDRWQERHILRP

SEQ ID NO: 206838 - protein, 14 aa, Unknown
  Description of Unknown: mammalian sequence
DDPEGPVMPGSHSV

SEQ ID NO: 206839 - protein, 23 aa, Unknown
  Description of Unknown: mammalian sequence
LCPSNPTCIYKYGDESSNSLPGH

SEQ ID NO: 206840 - protein, 35 aa, Unknown
  Description of Unknown: mammalian sequence
LCEALQHNLPPFTPPPHTEDSVYPMPRVIFRMFDY

SEQ ID NO: 206841 - protein, 5 aa, Unknown
  Description of Unknown: mammalian sequence
NMVTC

SEQ ID NO: 206842 - protein, 10 aa, Unknown
  Description of Unknown: mammalian sequence
NLEEHLGKLN

SEQ ID NO: 206843 - protein, 4 aa, Unknown
  Description of Unknown: mammalian sequence
QGAH

SEQ ID NO: 206844 - protein, 6 aa, Unknown
  Description of Unknown: mammalian sequence
QRIPLY

SEQ ID NO: 206845 - protein, 8 aa, Unknown
  Description of Unknown: mammalian sequence
QRKPLFYI

SEQ ID NO: 206846 - protein, 4 aa, Unknown
  Description of Unknown: mammalian sequence
AGGR

SEQ ID NO: 206847 - protein, 6 aa, Unknown
  Description of Unknown: mammalian sequence
YPYKGE

SEQ ID NO: 206848 - protein, 7 aa, Unknown
  Description of Unknown: mammalian sequence
NHETGEL

SEQ ID NO: 206849 - protein, 8 aa, Unknown
  Description of Unknown: mammalian sequence
TFELKTDV

SEQ ID NO: 206850 - protein, 25 aa, Unknown
  Description of Unknown: mammalian sequence
ALGLPHSDVFRQAKDVAESDRGFSL

SEQ ID NO: 206851 - protein, 4 aa, Unknown
  Description of Unknown: mammalian sequence
LKDW

SEQ ID NO: 206852 - protein, 4 aa, Unknown
  Description of Unknown: mammalian sequence
WTGM

SEQ ID NO: 206853 - protein, 4 aa, Unknown
  Description of Unknown: mammalian sequence
YNGL

SEQ ID NO: 206854 - protein, 5 aa, Unknown
  Description of Unknown: mammalian sequence
DRPGE

SEQ ID NO: 206855 - protein, 5 aa, Unknown
  Description of Unknown: mammalian sequence
LGVSI

SEQ ID NO: 206856 - protein, 5 aa, Unknown
  Description of Unknown: mammalian sequence
RSTGR

SEQ ID NO: 206857 - protein, 5 aa, Unknown
  Description of Unknown: mammalian sequence
YRMLP

SEQ ID NO: 206858 - protein, 5 aa, Unknown
  Description of Unknown: mammalian sequence
YVNDF

SEQ ID NO: 206859 - protein, 6 aa, Unknown
  Description of Unknown: mammalian sequence
EYGSPR

SEQ ID NO: 206860 - protein, 6 aa, Unknown
  Description of Unknown: mammalian sequence
IDRGRV

SEQ ID NO: 206861 - protein, 7 aa, Unknown
  Description of Unknown: mammalian sequence
RAADGQM

SEQ ID NO: 206862 - protein, 7 aa, Unknown
  Description of Unknown: mammalian sequence
TKEKNNV

SEQ ID NO: 206863 - protein, 8 aa, Unknown
  Description of Unknown: mammalian sequence
DQAGLGHE

SEQ ID NO: 206864 - protein, 8 aa, Unknown
  Description of Unknown: mammalian sequence
FSQIKDAM

SEQ ID NO: 206865 - protein, 8 aa, Unknown
  Description of Unknown: mammalian sequence
QAAPGKST

SEQ ID NO: 206866 - protein, 8 aa, Unknown
  Description of Unknown: mammalian sequence
QLPAGATQ

SEQ ID NO: 206867 - protein, 9 aa, Unknown
  Description of Unknown: mammalian sequence
AAKHPDMLT

SEQ ID NO: 206868 - protein, 9 aa, Unknown
  Description of Unknown: mammalian sequence
LASKLPTGV

SEQ ID NO: 206869 - protein, 9 aa, Unknown
  Description of Unknown: mammalian sequence
PNGLEDTPQ

SEQ ID NO: 206870 - protein, 9 aa, Unknown
  Description of Unknown: mammalian sequence
QERLSGNQA

SEQ ID NO: 206871 - protein, 12 aa, Unknown
  Description of Unknown: mammalian sequence
NGFGFAGRGQNT

SEQ ID NO: 206872 - protein, 14 aa, Unknown
  Description of Unknown: mammalian sequence
RLPSSFLPDEDQGV

SEQ ID NO: 206873 - protein, 15 aa, Unknown
  Description of Unknown: mammalian sequence
FNLPAIVELGTATGF

SEQ ID NO: 206874 - protein, 17 aa, Unknown
  Description of Unknown: mammalian sequence
MLKPIAKGDHGEGKKGF

SEQ ID NO: 206875 - protein, 7 aa, Unknown
  Description of Unknown: mammalian sequence
LAHLLPP

SEQ ID NO: 206876 - protein, 9 aa, Unknown
  Description of Unknown: mammalian sequence
QAPEAGFEH

SEQ ID NO: 206877 - protein, 10 aa, Unknown
  Description of Unknown: mammalian sequence
KDKFICDRPL

SEQ ID NO: 206878 - protein, 16 aa, Unknown
  Description of Unknown: mammalian sequence
PVEFHNPLKGHVAEPH

SEQ ID NO: 206879 - protein, 16 aa, Unknown
  Description of Unknown: mammalian sequence
QKTMPSAPAPDGLPSE

SEQ ID NO: 206880 - protein, 4 aa, Unknown
  Description of Unknown: mammalian sequence
AGRV

SEQ ID NO: 206881 - protein, 6 aa, Unknown
  Description of Unknown: mammalian sequence
AGHGFA

SEQ ID NO: 206882 - protein, 10 aa, Unknown
  Description of Unknown: mammalian sequence
LPPGPGPFPG

SEQ ID NO: 206883 - protein, 11 aa, Unknown
  Description of Unknown: mammalian sequence
IFGIGGGLLEY

SEQ ID NO: 206884 - protein, 15 aa, Unknown
  Description of Unknown: mammalian sequence
AYYNFEDLPNNMDNI

SEQ ID NO: 206885 - protein, 10 aa, Unknown
  Description of Unknown: mammalian sequence
MICTRSKPKC

SEQ ID NO: 206886 - protein, 6 aa, Unknown
  Description of Unknown: mammalian sequence
QSSLDL

SEQ ID NO: 206887 - protein, 6 aa, Unknown
  Description of Unknown: mammalian sequence
IPDGDE

SEQ ID NO: 206888 - protein, 15 aa, Unknown
  Description of Unknown: mammalian sequence
PTNPVTGEIPTLSAL

SEQ ID NO: 206889 - protein, 9 aa, Unknown
  Description of Unknown: mammalian sequence
GGPCRADIK

SEQ ID NO: 206890 - protein, 11 aa, Unknown
  Description of Unknown: mammalian sequence
SGACSTDKPCG

SEQ ID NO: 206891 - protein, 11 aa, Unknown
  Description of Unknown: mammalian sequence
EGSKTVPIADK

SEQ ID NO: 206892 - protein, 7 aa, Unknown
  Description of Unknown: mammalian sequence
INGKKPE

SEQ ID NO: 206893 - protein, 8 aa, Unknown
  Description of Unknown: mammalian sequence
ELPAYMSG

SEQ ID NO: 206894 - protein, 8 aa, Unknown
  Description of Unknown: mammalian sequence
VTGTLDYG

SEQ ID NO: 206895 - protein, 15 aa, Unknown
  Description of Unknown: mammalian sequence
AAEDAIEIHPGTPNV

SEQ ID NO: 206896 - protein, 21 aa, Unknown
  Description of Unknown: mammalian sequence
LEFKMPADGRIWGSKYPRPTA

SEQ ID NO: 206897 - protein, 5 aa, Unknown
  Description of Unknown: mammalian sequence
SDYDV

SEQ ID NO: 206898 - protein, 5 aa, Unknown
  Description of Unknown: mammalian sequence
VGSGP

SEQ ID NO: 206899 - protein, 6 aa, Unknown
  Description of Unknown: mammalian sequence
IDSQSA

SEQ ID NO: 206900 - protein, 6 aa, Unknown
  Description of Unknown: mammalian sequence
NKRDAY

SEQ ID NO: 206901 - protein, 6 aa, Unknown
  Description of Unknown: mammalian sequence
RKGIRT

SEQ ID NO: 206902 - protein, 7 aa, Unknown
  Description of Unknown: mammalian sequence
MGERFGG

SEQ ID NO: 206903 - protein, 8 aa, Unknown
  Description of Unknown: mammalian sequence
VDTGAEKR

SEQ ID NO: 206904 - protein, 10 aa, Unknown
  Description of Unknown: mammalian sequence
TGGHPSKEAQ

SEQ ID NO: 206905 - protein, 10 aa, Unknown
  Description of Unknown: mammalian sequence
VPAATEGGLH

SEQ ID NO: 206906 - protein, 18 aa, Unknown
  Description of Unknown: mammalian sequence
VLDTVDIENYISVPKTEG

SEQ ID NO: 206907 - protein, 5 aa, Unknown
  Description of Unknown: mammalian sequence
DLAYV

SEQ ID NO: 206908 - protein, 13 aa, Unknown
  Description of Unknown: mammalian sequence
VVPPELKTKDHII

SEQ ID NO: 206909 - protein, 5 aa, Unknown
  Description of Unknown: mammalian sequence
WKQHK

SEQ ID NO: 206910 - protein, 7 aa, Unknown
  Description of Unknown: mammalian sequence
KIQGCSA

SEQ ID NO: 206911 - protein, 8 aa, Unknown
  Description of Unknown: mammalian sequence
DVASGDGL

SEQ ID NO: 206912 - protein, 20 aa, Unknown
  Description of Unknown: mammalian sequence
VSPWHRMSYFFNPVSNFISF

SEQ ID NO: 206913 - protein, 5 aa, Unknown
  Description of Unknown: mammalian sequence
YDNDE

SEQ ID NO: 206914 - protein, 10 aa, Unknown
  Description of Unknown: mammalian sequence
RNGDSRRPGL

SEQ ID NO: 206915 - protein, 4 aa, Unknown
  Description of Unknown: mammalian sequence
VEET

SEQ ID NO: 206916 - protein, 6 aa, Unknown
  Description of Unknown: mammalian sequence
AIQDIS

SEQ ID NO: 206917 - protein, 6 aa, Unknown
  Description of Unknown: mammalian sequence
KLPITL

SEQ ID NO: 206918 - protein, 11 aa, Unknown
  Description of Unknown: mammalian sequence
ADSAYITYAND

SEQ ID NO: 206919 - protein, 4 aa, Unknown
  Description of Unknown: mammalian sequence
FGGV

SEQ ID NO: 206920 - protein, 4 aa, Unknown
  Description of Unknown: mammalian sequence
YGIK

SEQ ID NO: 206921 - protein, 5 aa, Unknown
  Description of Unknown: mammalian sequence
INFNS

SEQ ID NO: 206922 - protein, 5 aa, Unknown
  Description of Unknown: mammalian sequence
YGRDH

SEQ ID NO: 206923 - protein, 6 aa, Unknown
  Description of Unknown: mammalian sequence
GMSRTN

SEQ ID NO: 206924 - protein, 7 aa, Unknown
  Description of Unknown: mammalian sequence
ASLGING

SEQ ID NO: 206925 - protein, 7 aa, Unknown
  Description of Unknown: mammalian sequence
SAPRLQH

SEQ ID NO: 206926 - protein, 7 aa, Unknown
  Description of Unknown: mammalian sequence
YIPDFGG

SEQ ID NO: 206927 - protein, 8 aa, Unknown
  Description of Unknown: mammalian sequence
SLPNYLAP

SEQ ID NO: 206928 - protein, 9 aa, Unknown
  Description of Unknown: mammalian sequence
LDGKFADNV

SEQ ID NO: 206929 - protein, 9 aa, Unknown
  Description of Unknown: mammalian sequence
VINNVNADP

SEQ ID NO: 206930 - protein, 10 aa, Unknown
  Description of Unknown: mammalian sequence
QTQHALEKLS

SEQ ID NO: 206931 - protein, 11 aa, Unknown
  Description of Unknown: mammalian sequence
EGKVFKTRHTG

SEQ ID NO: 206932 - protein, 11 aa, Unknown
  Description of Unknown: mammalian sequence
VKADSEGQPGP

SEQ ID NO: 206933 - protein, 12 aa, Unknown
  Description of Unknown: mammalian sequence
RAFVYHPDIEDR

SEQ ID NO: 206934 - protein, 13 aa, Unknown
  Description of Unknown: mammalian sequence
AFGDVDTADPLDP

SEQ ID NO: 206935 - protein, 13 aa, Unknown
  Description of Unknown: mammalian sequence
LKTETHARGEGST

SEQ ID NO: 206936 - protein, 16 aa, Unknown
  Description of Unknown: mammalian sequence
KNGPIDFQPREPFSAL

SEQ ID NO: 206937 - protein, 16 aa, Unknown
  Description of Unknown: mammalian sequence
VINPGTDRNWTGHPFV

SEQ ID NO: 206938 - protein, 17 aa, Unknown
  Description of Unknown: mammalian sequence
QITQEYFGFATHLAYQG

SEQ ID NO: 206939 - protein, 22 aa, Unknown
  Description of Unknown: mammalian sequence
NHWDNLNRVVERGYAGLSLWDW

SEQ ID NO: 206940 - protein, 15 aa, Unknown
  Description of Unknown: mammalian sequence
VGSLVSGPSFTSGEV

SEQ ID NO: 206941 - protein, 13 aa, Unknown
  Description of Unknown: mammalian sequence
ITSQETDGWYTLA

SEQ ID NO: 206942 - protein, 21 aa, Unknown
  Description of Unknown: mammalian sequence
RNKEGQDVNEQGQPIRGRTQD

SEQ ID NO: 206943 - protein, 5 aa, Unknown
  Description of Unknown: mammalian sequence
HFQPF

SEQ ID NO: 206944 - protein, 5 aa, Unknown
  Description of Unknown: mammalian sequence
TGTPV

SEQ ID NO: 206945 - protein, 7 aa, Unknown
  Description of Unknown: mammalian sequence
PLSHFDA

SEQ ID NO: 206946 - protein, 4 aa, Unknown
  Description of Unknown: mammalian sequence
FNPI

SEQ ID NO: 206947 - protein, 4 aa, Unknown
  Description of Unknown: mammalian sequence
KNGS

SEQ ID NO: 206948 - protein, 5 aa, Unknown
  Description of Unknown: mammalian sequence
DRFQG

SEQ ID NO: 206949 - protein, 5 aa, Unknown
  Description of Unknown: mammalian sequence
EVPDI

SEQ ID NO: 206950 - protein, 6 aa, Unknown
  Description of Unknown: mammalian sequence
ACELHT

SEQ ID NO: 206951 - protein, 6 aa, Unknown
  Description of Unknown: mammalian sequence
LPATLT

SEQ ID NO: 206952 - protein, 6 aa, Unknown
  Description of Unknown: mammalian sequence
LPDPYG

SEQ ID NO: 206953 - protein, 6 aa, Unknown
  Description of Unknown: mammalian sequence
LPHAQP

SEQ ID NO: 206954 - protein, 6 aa, Unknown
  Description of Unknown: mammalian sequence
RQQASF

SEQ ID NO: 206955 - protein, 6 aa, Unknown
  Description of Unknown: mammalian sequence
YIGGNL

SEQ ID NO: 206956 - protein, 7 aa, Unknown
  Description of Unknown: mammalian sequence
FGRTCKE

SEQ ID NO: 206957 - protein, 7 aa, Unknown
  Description of Unknown: mammalian sequence
VDKGDNV

SEQ ID NO: 206958 - protein, 7 aa, Unknown
  Description of Unknown: mammalian sequence
WGPECNH

SEQ ID NO: 206959 - protein, 8 aa, Unknown
  Description of Unknown: mammalian sequence
VRRCEAQK

SEQ ID NO: 206960 - protein, 9 aa, Unknown
  Description of Unknown: mammalian sequence
KVLIKEEDA

SEQ ID NO: 206961 - protein, 9 aa, Unknown
  Description of Unknown: mammalian sequence
SCATGWKGL

SEQ ID NO: 206962 - protein, 10 aa, Unknown
  Description of Unknown: mammalian sequence
IVDLPDHIEV

SEQ ID NO: 206963 - protein, 10 aa, Unknown
  Description of Unknown: mammalian sequence
LCTACMNNGV

SEQ ID NO: 206964 - protein, 13 aa, Unknown
  Description of Unknown: mammalian sequence
RCSGQEGCKSYVF

SEQ ID NO: 206965 - protein, 22 aa, Unknown
  Description of Unknown: mammalian sequence
LCSPGWQGLQCEREGIPRMTPK

SEQ ID NO: 206966 - protein, 25 aa, Unknown
  Description of Unknown: mammalian sequence
CNEACHPGFYGPDCKLRCSCNNGEM

SEQ ID NO: 206967 - protein, 4 aa, Unknown
  Description of Unknown: mammalian sequence
LKTP

SEQ ID NO: 206968 - protein, 14 aa, Unknown
  Description of Unknown: mammalian sequence
AKGRRAEDGSVIDY

SEQ ID NO: 206969 - protein, 12 aa, Unknown
  Description of Unknown: mammalian sequence
AARPLRVHRRPL

SEQ ID NO: 206970 - protein, 4 aa, Unknown
  Description of Unknown: mammalian sequence
LIPL

SEQ ID NO: 206971 - protein, 5 aa, Unknown
  Description of Unknown: mammalian sequence
FGEGA

SEQ ID NO: 206972 - protein, 6 aa, Unknown
  Description of Unknown: mammalian sequence
AFDDAK

SEQ ID NO: 206973 - protein, 6 aa, Unknown
  Description of Unknown: mammalian sequence
KVNGKR

SEQ ID NO: 206974 - protein, 7 aa, Unknown
  Description of Unknown: mammalian sequence
LSKTGMP

SEQ ID NO: 206975 - protein, 8 aa, Unknown
  Description of Unknown: mammalian sequence
VLPYPRMR

SEQ ID NO: 206976 - protein, 8 aa, Unknown
  Description of Unknown: mammalian sequence
VRADDGLL

SEQ ID NO: 206977 - protein, 16 aa, Unknown
  Description of Unknown: mammalian sequence
EAEDDFKIEKPTKEDA

SEQ ID NO: 206978 - protein, 5 aa, Unknown
  Description of Unknown: mammalian sequence
IRFGR

SEQ ID NO: 206979 - protein, 6 aa, Unknown
  Description of Unknown: mammalian sequence
QTETHV

SEQ ID NO: 206980 - protein, 13 aa, Unknown
  Description of Unknown: mammalian sequence
PLKGRYTPSVGDV

SEQ ID NO: 206981 - protein, 7 aa, Unknown
  Description of Unknown: mammalian sequence
KNPALSD

SEQ ID NO: 206982 - protein, 12 aa, Unknown
  Description of Unknown: mammalian sequence
RFGSSEIGKGKK

SEQ ID NO: 206983 - protein, 14 aa, Unknown
  Description of Unknown: mammalian sequence
GKFSGRKGTWVGFT

SEQ ID NO: 206984 - protein, 9 aa, Unknown
  Description of Unknown: mammalian sequence
QFFMSDKPL

SEQ ID NO: 206985 - protein, 11 aa, Unknown
  Description of Unknown: mammalian sequence
HAPRDMGPQPR

SEQ ID NO: 206986 - protein, 12 aa, Unknown
  Description of Unknown: mammalian sequence
HFKPAPWNGLPA

SEQ ID NO: 206987 - protein, 6 aa, Unknown
  Description of Unknown: mammalian sequence
LDPPKQ

SEQ ID NO: 206988 - protein, 6 aa, Unknown
  Description of Unknown: mammalian sequence
TATADD

SEQ ID NO: 206989 - protein, 7 aa, Unknown
  Description of Unknown: mammalian sequence
AEAQTCR

SEQ ID NO: 206990 - protein, 7 aa, Unknown
  Description of Unknown: mammalian sequence
EEKPQGQ

SEQ ID NO: 206991 - protein, 7 aa, Unknown
  Description of Unknown: mammalian sequence
LGLNDPL

SEQ ID NO: 206992 - protein, 7 aa, Unknown
  Description of Unknown: mammalian sequence
RFPTLPF

SEQ ID NO: 206993 - protein, 9 aa, Unknown
  Description of Unknown: mammalian sequence
ISSFDRPNI

SEQ ID NO: 206994 - protein, 13 aa, Unknown
  Description of Unknown: mammalian sequence
YFGEGRQEPCGNC

SEQ ID NO: 206995 - protein, 7 aa, Unknown
  Description of Unknown: mammalian sequence
LGLNRKW

SEQ ID NO: 206996 - protein, 12 aa, Unknown
  Description of Unknown: mammalian sequence
YFGSYGTRGVGY

SEQ ID NO: 206997 - protein, 4 aa, Unknown
  Description of Unknown: mammalian sequence
NIKG

SEQ ID NO: 206998 - protein, 5 aa, Unknown
  Description of Unknown: mammalian sequence
NPVPQ

SEQ ID NO: 206999 - protein, 6 aa, Unknown
  Description of Unknown: mammalian sequence
AKFPAD

SEQ ID NO: 207000 - protein, 6 aa, Unknown
  Description of Unknown: mammalian sequence
IQNVDF

SEQ ID NO: 207001 - protein, 6 aa, Unknown
  Description of Unknown: mammalian sequence
LTGQMV

SEQ ID NO: 207002 - protein, 8 aa, Unknown
  Description of Unknown: mammalian sequence
AAEDARQY

SEQ ID NO: 207003 - protein, 16 aa, Unknown
  Description of Unknown: mammalian sequence
KLDGSQTSKWLSSEPL

SEQ ID NO: 207004 - protein, 4 aa, Unknown
  Description of Unknown: mammalian sequence
DIFK

SEQ ID NO: 207005 - protein, 4 aa, Unknown
  Description of Unknown: mammalian sequence
LPGM

SEQ ID NO: 207006 - protein, 6 aa, Unknown
  Description of Unknown: mammalian sequence
IPGNGG

SEQ ID NO: 207007 - protein, 6 aa, Unknown
  Description of Unknown: mammalian sequence
VEDWVE

SEQ ID NO: 207008 - protein, 15 aa, Unknown
  Description of Unknown: mammalian sequence
RLKADETYTSPEDYF

SEQ ID NO: 207009 - protein, 5 aa, Unknown
  Description of Unknown: mammalian sequence
RKPTE

SEQ ID NO: 207010 - protein, 6 aa, Unknown
  Description of Unknown: mammalian sequence
YARTIV

SEQ ID NO: 207011 - protein, 4 aa, Unknown
  Description of Unknown: mammalian sequence
REDG

SEQ ID NO: 207012 - protein, 4 aa, Unknown
  Description of Unknown: mammalian sequence
YKTL

SEQ ID NO: 207013 - protein, 6 aa, Unknown
  Description of Unknown: mammalian sequence
DRAKRI

SEQ ID NO: 207014 - protein, 11 aa, Unknown
  Description of Unknown: mammalian sequence
KAPQTEPPASI

SEQ ID NO: 207015 - protein, 21 aa, Unknown
  Description of Unknown: mammalian sequence
AAQSDRPAHAQGVPLTRIERT

SEQ ID NO: 207016 - protein, 8 aa, Unknown
  Description of Unknown: mammalian sequence
DWDKDADP

SEQ ID NO: 207017 - protein, 14 aa, Unknown
  Description of Unknown: mammalian sequence
LFDRHVSSSVRLND

SEQ ID NO: 207018 - protein, 26 aa, Unknown
  Description of Unknown: mammalian sequence
LVEESSRQLPTAAPEPAKVDQDAGRL

SEQ ID NO: 207019 - protein, 6 aa, Unknown
  Description of Unknown: mammalian sequence
LLGVTP

SEQ ID NO: 207020 - protein, 4 aa, Unknown
  Description of Unknown: mammalian sequence
DTLP

SEQ ID NO: 207021 - protein, 4 aa, Unknown
  Description of Unknown: mammalian sequence
ENGL

SEQ ID NO: 207022 - protein, 4 aa, Unknown
  Description of Unknown: mammalian sequence
FREV

SEQ ID NO: 207023 - protein, 4 aa, Unknown
  Description of Unknown: mammalian sequence
KVSP

SEQ ID NO: 207024 - protein, 4 aa, Unknown
  Description of Unknown: mammalian sequence
LDGK

SEQ ID NO: 207025 - protein, 4 aa, Unknown
  Description of Unknown: mammalian sequence
LNGK

SEQ ID NO: 207026 - protein, 4 aa, Unknown
  Description of Unknown: mammalian sequence
PLLI

SEQ ID NO: 207027 - protein, 4 aa, Unknown
  Description of Unknown: mammalian sequence
SGQT

SEQ ID NO: 207028 - protein, 5 aa, Unknown
  Description of Unknown: mammalian sequence
KNPRG

SEQ ID NO: 207029 - protein, 5 aa, Unknown
  Description of Unknown: mammalian sequence
KPTTQ

SEQ ID NO: 207030 - protein, 5 aa, Unknown
  Description of Unknown: mammalian sequence
SLKWK

SEQ ID NO: 207031 - protein, 5 aa, Unknown
  Description of Unknown: mammalian sequence
TSEMD

SEQ ID NO: 207032 - protein, 6 aa, Unknown
  Description of Unknown: mammalian sequence
LSGQEA

SEQ ID NO: 207033 - protein, 9 aa, Unknown
  Description of Unknown: mammalian sequence
PLDVAPQGK

SEQ ID NO: 207034 - protein, 11 aa, Unknown
  Description of Unknown: mammalian sequence
AKNTYDDSAWT

SEQ ID NO: 207035 - protein, 12 aa, Unknown
  Description of Unknown: mammalian sequence
ELPELPQPESAG

SEQ ID NO: 207036 - protein, 12 aa, Unknown
  Description of Unknown: mammalian sequence
QPNATAWSEAGH

SEQ ID NO: 207037 - protein, 12 aa, Unknown
  Description of Unknown: mammalian sequence
SEYLFRHSDNEL

SEQ ID NO: 207038 - protein, 13 aa, Unknown
  Description of Unknown: mammalian sequence
VAYTAPKVQLPSL

SEQ ID NO: 207039 - protein, 15 aa, Unknown
  Description of Unknown: mammalian sequence
NLSVTLPAASHAIPH

SEQ ID NO: 207040 - protein, 16 aa, Unknown
  Description of Unknown: mammalian sequence
IDNMGLDEDWTIGSED

SEQ ID NO: 207041 - protein, 23 aa, Unknown
  Description of Unknown: mammalian sequence
TGNLGGENYRDTVRGPLNEGGLY

SEQ ID NO: 207042 - protein, 10 aa, Unknown
  Description of Unknown: mammalian sequence
SNADLQTLPA

SEQ ID NO: 207043 - protein, 11 aa, Unknown
  Description of Unknown: mammalian sequence
LRGKIVPTPMQ

SEQ ID NO: 207044 - protein, 12 aa, Unknown
  Description of Unknown: mammalian sequence
KGGVAYRLPVPG

SEQ ID NO: 207045 - protein, 11 aa, Unknown
  Description of Unknown: mammalian sequence
QAWATAPYAPT

SEQ ID NO: 207046 - protein, 7 aa, Unknown
  Description of Unknown: mammalian sequence
YSKGVSQ

SEQ ID NO: 207047 - protein, 6 aa, Unknown
  Description of Unknown: mammalian sequence
QKGRVL

SEQ ID NO: 207048 - protein, 6 aa, Unknown
  Description of Unknown: mammalian sequence
VLGKEL

SEQ ID NO: 207049 - protein, 4 aa, Unknown
  Description of Unknown: mammalian sequence
ANTP

SEQ ID NO: 207050 - protein, 4 aa, Unknown
  Description of Unknown: mammalian sequence
DAPT

SEQ ID NO: 207051 - protein, 5 aa, Unknown
  Description of Unknown: mammalian sequence
LDPIK

SEQ ID NO: 207052 - protein, 5 aa, Unknown
  Description of Unknown: mammalian sequence
TTDFQ

SEQ ID NO: 207053 - protein, 6 aa, Unknown
  Description of Unknown: mammalian sequence
PWNKEV

SEQ ID NO: 207054 - protein, 6 aa, Unknown
  Description of Unknown: mammalian sequence
QQLLPP

SEQ ID NO: 207055 - protein, 8 aa, Unknown
  Description of Unknown: mammalian sequence
TDPQTGKT

SEQ ID NO: 207056 - protein, 9 aa, Unknown
  Description of Unknown: mammalian sequence
GRHGIVPTR

SEQ ID NO: 207057 - protein, 9 aa, Unknown
  Description of Unknown: mammalian sequence
TADGSWFFK

SEQ ID NO: 207058 - protein, 12 aa, Unknown
  Description of Unknown: mammalian sequence
LFSMGVTRGKWG

SEQ ID NO: 207059 - protein, 18 aa, Unknown
  Description of Unknown: mammalian sequence
LAPGMGEDGELEETGVPA

SEQ ID NO: 207060 - protein, 21 aa, Unknown
  Description of Unknown: mammalian sequence
CWVMHPGESWHGFKDIPDNWS

SEQ ID NO: 207061 - protein, 7 aa, Unknown
  Description of Unknown: mammalian sequence
EVHVRGH

SEQ ID NO: 207062 - protein, 17 aa, Unknown
  Description of Unknown: mammalian sequence
VGDPGPICRPWECCDKA

SEQ ID NO: 207063 - protein, 7 aa, Unknown
  Description of Unknown: mammalian sequence
KYEIPEG

SEQ ID NO: 207064 - protein, 7 aa, Unknown
  Description of Unknown: mammalian sequence
RKVCEQE

SEQ ID NO: 207065 - protein, 12 aa, Unknown
  Description of Unknown: mammalian sequence
EQLLPKLFDGCY

SEQ ID NO: 207066 - protein, 5 aa, Unknown
  Description of Unknown: mammalian sequence
SLHFS

SEQ ID NO: 207067 - protein, 6 aa, Unknown
  Description of Unknown: mammalian sequence
VYPLQW

SEQ ID NO: 207068 - protein, 7 aa, Unknown
  Description of Unknown: mammalian sequence
KTVSGLY

SEQ ID NO: 207069 - protein, 12 aa, Unknown
  Description of Unknown: mammalian sequence
SDPAFQPPCSEV

SEQ ID NO: 207070 - protein, 13 aa, Unknown
  Description of Unknown: mammalian sequence
SVVKPIGLAPLVY

SEQ ID NO: 207071 - protein, 30 aa, Unknown
  Description of Unknown: mammalian sequence
ARWHSRLGFFRDPRPFPLPLSSLFSDGGNV

SEQ ID NO: 207072 - protein, 15 aa, Unknown
  Description of Unknown: mammalian sequence
ELRSLTRHPKYKTEL

SEQ ID NO: 207073 - protein, 7 aa, Unknown
  Description of Unknown: mammalian sequence
VYNTFCI

SEQ ID NO: 207074 - protein, 4 aa, Unknown
  Description of Unknown: mammalian sequence
AATM

SEQ ID NO: 207075 - protein, 4 aa, Unknown
  Description of Unknown: mammalian sequence
FAGT

SEQ ID NO: 207076 - protein, 4 aa, Unknown
  Description of Unknown: mammalian sequence
RGDF

SEQ ID NO: 207077 - protein, 4 aa, Unknown
  Description of Unknown: mammalian sequence
SNPW

SEQ ID NO: 207078 - protein, 4 aa, Unknown
  Description of Unknown: mammalian sequence
SPDK

SEQ ID NO: 207079 - protein, 7 aa, Unknown
  Description of Unknown: mammalian sequence
KTADQQD

SEQ ID NO: 207080 - protein, 8 aa, Unknown
  Description of Unknown: mammalian sequence
QGAGAVDA

SEQ ID NO: 207081 - protein, 9 aa, Unknown
  Description of Unknown: mammalian sequence
AKQDDDSHY

SEQ ID NO: 207082 - protein, 9 aa, Unknown
  Description of Unknown: mammalian sequence
DKDNTSSKV

SEQ ID NO: 207083 - protein, 9 aa, Unknown
  Description of Unknown: mammalian sequence
NLSALEKPI

SEQ ID NO: 207084 - protein, 11 aa, Unknown
  Description of Unknown: mammalian sequence
IHRHANGKPYA

SEQ ID NO: 207085 - protein, 16 aa, Unknown
  Description of Unknown: mammalian sequence
EGVENIEDIESSEITE

SEQ ID NO: 207086 - protein, 36 aa, Unknown
  Description of Unknown: mammalian sequence
DSKDGSSYYHEANSDAKDQLDGDGLQFYALKNNFTA

SEQ ID NO: 207087 - protein, 9 aa, Unknown
  Description of Unknown: mammalian sequence
GSIQGQDLS

SEQ ID NO: 207088 - protein, 4 aa, Unknown
  Description of Unknown: mammalian sequence
RFDT

SEQ ID NO: 207089 - protein, 15 aa, Unknown
  Description of Unknown: mammalian sequence
TLTTPASNQLLALPR

SEQ ID NO: 207090 - protein, 4 aa, Unknown
  Description of Unknown: mammalian sequence
ELPF

SEQ ID NO: 207091 - protein, 7 aa, Unknown
  Description of Unknown: mammalian sequence
AGDNPDA

SEQ ID NO: 207092 - protein, 7 aa, Unknown
  Description of Unknown: mammalian sequence
VTTAEAY

SEQ ID NO: 207093 - protein, 11 aa, Unknown
  Description of Unknown: mammalian sequence
AFPGLNGMDLA

SEQ ID NO: 207094 - protein, 18 aa, Unknown
  Description of Unknown: mammalian sequence
WTQGSWTLTGGLPQAKKE

SEQ ID NO: 207095 - protein, 16 aa, Unknown
  Description of Unknown: mammalian sequence
RGIKLTKIKLDLPINF

SEQ ID NO: 207096 - protein, 4 aa, Unknown
  Description of Unknown: mammalian sequence
FLDV

SEQ ID NO: 207097 - protein, 5 aa, Unknown
  Description of Unknown: mammalian sequence
QTSLS

SEQ ID NO: 207098 - protein, 26 aa, Unknown
  Description of Unknown: mammalian sequence
YTGKWGLNDVNPEAWPRDLKGMAAVR

SEQ ID NO: 207099 - protein, 17 aa, Unknown
  Description of Unknown: mammalian sequence
VKEGAGQPDFCDGHSPA

SEQ ID NO: 207100 - protein, 9 aa, Unknown
  Description of Unknown: mammalian sequence
VDGSRGDGS

SEQ ID NO: 207101 - protein, 41 aa, Unknown
  Description of Unknown: mammalian sequence
LKARVGSADDAKKDAAKKDDAKKDDAKKDGSQTNKAKNLVQ

SEQ ID NO: 207102 - protein, 7 aa, Unknown
  Description of Unknown: mammalian sequence
VAKEGET

SEQ ID NO: 207103 - protein, 14 aa, Unknown
  Description of Unknown: mammalian sequence
TMKNTGRNVNDRPV

SEQ ID NO: 207104 - protein, 4 aa, Unknown
  Description of Unknown: mammalian sequence
EVND

SEQ ID NO: 207105 - protein, 4 aa, Unknown
  Description of Unknown: mammalian sequence
NSDG

SEQ ID NO: 207106 - protein, 4 aa, Unknown
  Description of Unknown: mammalian sequence
TPYG

SEQ ID NO: 207107 - protein, 5 aa, Unknown
  Description of Unknown: mammalian sequence
GRGNP

SEQ ID NO: 207108 - protein, 5 aa, Unknown
  Description of Unknown: mammalian sequence
SENPV

SEQ ID NO: 207109 - protein, 6 aa, Unknown
  Description of Unknown: mammalian sequence
RAQMDL

SEQ ID NO: 207110 - protein, 6 aa, Unknown
  Description of Unknown: mammalian sequence
RTSRNP

SEQ ID NO: 207111 - protein, 6 aa, Unknown
  Description of Unknown: mammalian sequence
YVLNDI

SEQ ID NO: 207112 - protein, 7 aa, Unknown
  Description of Unknown: mammalian sequence
AKKDGTH

SEQ ID NO: 207113 - protein, 8 aa, Unknown
  Description of Unknown: mammalian sequence
DATHIGKL

SEQ ID NO: 207114 - protein, 8 aa, Unknown
  Description of Unknown: mammalian sequence
KQIGGDGM

SEQ ID NO: 207115 - protein, 8 aa, Unknown
  Description of Unknown: mammalian sequence
VLTIPEII

SEQ ID NO: 207116 - protein, 8 aa, Unknown
  Description of Unknown: mammalian sequence
YKFQEGQE

SEQ ID NO: 207117 - protein, 9 aa, Unknown
  Description of Unknown: mammalian sequence
NAKDDEGVL

SEQ ID NO: 207118 - protein, 9 aa, Unknown
  Description of Unknown: mammalian sequence
SYGQFEDGI

SEQ ID NO: 207119 - protein, 10 aa, Unknown
  Description of Unknown: mammalian sequence
HGHVCFQFDA

SEQ ID NO: 207120 - protein, 16 aa, Unknown
  Description of Unknown: mammalian sequence
LFNPWCEDDAVYLDNE

SEQ ID NO: 207121 - protein, 20 aa, Unknown
  Description of Unknown: mammalian sequence
GSWDNIYAYGVPPSAWTGSV

SEQ ID NO: 207122 - protein, 20 aa, Unknown
  Description of Unknown: mammalian sequence
MYGAKKPLNTEGVMKSRSNV

SEQ ID NO: 207123 - protein, 5 aa, Unknown
  Description of Unknown: mammalian sequence
CPPCP

SEQ ID NO: 207124 - protein, 6 aa, Unknown
  Description of Unknown: mammalian sequence
QPKAAP

SEQ ID NO: 207125 - protein, 25 aa, Unknown
  Description of Unknown: mammalian sequence
PPPPPASSTTFSTTRRSSTTSSSPS

SEQ ID NO: 207126 - protein, 27 aa, Unknown
  Description of Unknown: mammalian sequence
GGNPPGGNPPGTTTPRPATSTGSSPGP

SEQ ID NO: 207127 - protein, 33 aa, Unknown
  Description of Unknown: mammalian sequence
GTSTGGSTTTTASGTTSTKASTTSTSSTSTGTG

SEQ ID NO: 207128 - protein, 33 aa, Unknown
  Description of Unknown: mammalian sequence
TVSSSSVSSSHSSTSTSSSHSSSSTPPTQPTGV

SEQ ID NO: 207129 - protein, 34 aa, Unknown
  Description of Unknown: mammalian sequence
GSSGTPPSNPSSSASPTSSTAKPSSTSTASNPSG

SEQ ID NO: 207130 - protein, 41 aa, Unknown
  Description of Unknown: mammalian sequence
ASSSSSTRAASTTSRVSPTTSRSSSATPPPGSTTTRVPPVG

SEQ ID NO: 207131 - protein, 48 aa, Unknown
  Description of Unknown: mammalian sequence
PSSGGTSSSSSAAPQSTSTKASTTTSAVRTTSTATTKTTSSAPAQGTN

SEQ ID NO: 207132 - protein, 6 aa, Unknown
  Description of Unknown: mammalian sequence
ASTKGP

SEQ ID NO: 207133 - protein, 12 aa, Unknown
  Description of Unknown: mammalian sequence
TVAAPSVFIFPP

SEQ ID NO: 207134 - protein, 13 aa, Unknown
  Description of Unknown: mammalian sequence
ASTKGPSVFPLAP

SEQ ID NO: 207135 - protein, 13 aa, Unknown
  Description of Unknown: mammalian sequence
QPKAAPSVTLFPP

SEQ ID NO: 207136 - protein, 5 aa, Unknown
  Description of Unknown: mammalian sequence
RSANS

SEQ ID NO: 207137 - protein, 9 aa, Unknown
  Description of Unknown: mammalian sequence
RPAKLALPP

SEQ ID NO: 207138 - protein, 17 aa, Unknown
  Description of Unknown: mammalian sequence
SLHGFDLASEQHTVRDT

SEQ ID NO: 207139 - protein, 4 aa, Unknown
  Description of Unknown: mammalian sequence
RARI

SEQ ID NO: 207140 - protein, 11 aa, Unknown
  Description of Unknown: mammalian sequence
TKPQLGIREGM

SEQ ID NO: 207141 - protein, 21 aa, Unknown
  Description of Unknown: mammalian sequence
HKPMAAPTTLKAGPLLSSEKL

SEQ ID NO: 207142 - protein, 12 aa, Unknown
  Description of Unknown: mammalian sequence
SLPADRKPGEPV

SEQ ID NO: 207143 - protein, 6 aa, Unknown
  Description of Unknown: mammalian sequence
RRHGEY

SEQ ID NO: 207144 - protein, 7 aa, Unknown
  Description of Unknown: mammalian sequence
ANQNSAE

SEQ ID NO: 207145 - protein, 14 aa, Unknown
  Description of Unknown: mammalian sequence
LTTNLTAFFREAHH

SEQ ID NO: 207146 - protein, 4 aa, Unknown
  Description of Unknown: mammalian sequence
PNQR

SEQ ID NO: 207147 - protein, 5 aa, Unknown
  Description of Unknown: mammalian sequence
ARNDP

SEQ ID NO: 207148 - protein, 5 aa, Unknown
  Description of Unknown: mammalian sequence
LNWTR

SEQ ID NO: 207149 - protein, 6 aa, Unknown
  Description of Unknown: mammalian sequence
DAATDR

SEQ ID NO: 207150 - protein, 6 aa, Unknown
  Description of Unknown: mammalian sequence
DKASGA

SEQ ID NO: 207151 - protein, 6 aa, Unknown
  Description of Unknown: mammalian sequence
GPNGNI

SEQ ID NO: 207152 - protein, 9 aa, Unknown
  Description of Unknown: mammalian sequence
AWDNSDSSV

SEQ ID NO: 207153 - protein, 9 aa, Unknown
  Description of Unknown: mammalian sequence
LAHVGRSLI

SEQ ID NO: 207154 - protein, 9 aa, Unknown
  Description of Unknown: mammalian sequence
TKNPQRGTF

SEQ ID NO: 207155 - protein, 11 aa, Unknown
  Description of Unknown: mammalian sequence
APMPAGLETWV

SEQ ID NO: 207156 - protein, 16 aa, Unknown
  Description of Unknown: mammalian sequence
DTGTLPNLNSEVGAGW

SEQ ID NO: 207157 - protein, 18 aa, Unknown
  Description of Unknown: mammalian sequence
ANHMWNPTGAHQSSIPAL

SEQ ID NO: 207158 - protein, 4 aa, Unknown
  Description of Unknown: mammalian sequence
DATE

SEQ ID NO: 207159 - protein, 7 aa, Unknown
  Description of Unknown: mammalian sequence
RNYLINS

SEQ ID NO: 207160 - protein, 14 aa, Unknown
  Description of Unknown: mammalian sequence
SSPKNLDDKVKLSE

SEQ ID NO: 207161 - protein, 5 aa, Unknown
  Description of Unknown: mammalian sequence
QYQIV

SEQ ID NO: 207162 - protein, 8 aa, Unknown
  Description of Unknown: mammalian sequence
RWLKNASP

SEQ ID NO: 207163 - protein, 14 aa, Unknown
  Description of Unknown: mammalian sequence
NILNDRNPVVTEDV

SEQ ID NO: 207164 - protein, 5 aa, Unknown
  Description of Unknown: mammalian sequence
YTPGE

SEQ ID NO: 207165 - protein, 4 aa, Unknown
  Description of Unknown: mammalian sequence
FGTQ

SEQ ID NO: 207166 - protein, 6 aa, Unknown
  Description of Unknown: mammalian sequence
SLQSGY

SEQ ID NO: 207167 - protein, 6 aa, Unknown
  Description of Unknown: mammalian sequence
TIPANR

SEQ ID NO: 207168 - protein, 9 aa, Unknown
  Description of Unknown: mammalian sequence
KSEKGRNKF

SEQ ID NO: 207169 - protein, 7 aa, Unknown
  Description of Unknown: mammalian sequence
YFNKYSS

SEQ ID NO: 207170 - protein, 8 aa, Unknown
  Description of Unknown: mammalian sequence
YRNPSRNI

SEQ ID NO: 207171 - protein, 4 aa, Unknown
  Description of Unknown: mammalian sequence
YGLN

SEQ ID NO: 207172 - protein, 5 aa, Unknown
  Description of Unknown: mammalian sequence
IMGSV

SEQ ID NO: 207173 - protein, 5 aa, Unknown
  Description of Unknown: mammalian sequence
SGRDA

SEQ ID NO: 207174 - protein, 6 aa, Unknown
  Description of Unknown: mammalian sequence
LIEKGG

SEQ ID NO: 207175 - protein, 7 aa, Unknown
  Description of Unknown: mammalian sequence
DINNISP

SEQ ID NO: 207176 - protein, 7 aa, Unknown
  Description of Unknown: mammalian sequence
GRHVRGI

SEQ ID NO: 207177 - protein, 8 aa, Unknown
  Description of Unknown: mammalian sequence
VRGREPGD

SEQ ID NO: 207178 - protein, 6 aa, Unknown
  Description of Unknown: mammalian sequence
EMEIPE

SEQ ID NO: 207179 - protein, 6 aa, Unknown
  Description of Unknown: mammalian sequence
RMIKSA

SEQ ID NO: 207180 - protein, 4 aa, Unknown
  Description of Unknown: mammalian sequence
GFTP

SEQ ID NO: 207181 - protein, 5 aa, Unknown
  Description of Unknown: mammalian sequence
FKIDV

SEQ ID NO: 207182 - protein, 5 aa, Unknown
  Description of Unknown: mammalian sequence
NLDDP

SEQ ID NO: 207183 - protein, 11 aa, Unknown
  Description of Unknown: mammalian sequence
LQNQQDNRGNI

SEQ ID NO: 207184 - protein, 19 aa, Unknown
  Description of Unknown: mammalian sequence
NPQGQVWIEGREQQPQKNI

SEQ ID NO: 207185 - protein, 35 aa, Unknown
  Description of Unknown: mammalian sequence
RVQGPFSVIRPPLRSQRPQEEVNGLEETICSARCT

SEQ ID NO: 207186 - protein, 53 aa, Unknown
  Description of Unknown: mammalian sequence
DSSVFQPGGGSPFGEGQGQGQQGQGQGHQGQGQGQQGQQGQQGQQSQGQGFRD

SEQ ID NO: 207187 - protein, 5 aa, Unknown
  Description of Unknown: mammalian sequence
CEGSD

SEQ ID NO: 207188 - protein, 7 aa, Unknown
  Description of Unknown: mammalian sequence
VQQQETI

SEQ ID NO: 207189 - protein, 8 aa, Unknown
  Description of Unknown: mammalian sequence
KGINSKKT

SEQ ID NO: 207190 - protein, 12 aa, Unknown
  Description of Unknown: mammalian sequence
RLKLEDRQVDLT

SEQ ID NO: 207191 - protein, 8 aa, Unknown
  Description of Unknown: mammalian sequence
TDSTQIKM

SEQ ID NO: 207192 - protein, 11 aa, Unknown
  Description of Unknown: mammalian sequence
ILLQYNTEDAY

SEQ ID NO: 207193 - protein, 14 aa, Unknown
  Description of Unknown: mammalian sequence
ELVTNCFKNRYTLQ

SEQ ID NO: 207194 - protein, 23 aa, Unknown
  Description of Unknown: mammalian sequence
IKLYLGYKNKKLRVNINVPMKTE

SEQ ID NO: 207195 - protein, 24 aa, Unknown
  Description of Unknown: mammalian sequence
KSKLLVLEDENANVDEVELKPDTL

SEQ ID NO: 207196 - protein, 11 aa, Unknown
  Description of Unknown: mammalian sequence
VLTFDLAAPTV

SEQ ID NO: 207197 - protein, 27 aa, Unknown
  Description of Unknown: mammalian sequence
CPAGNFIGKTATPYTSGTPCGDCPSDC

SEQ ID NO: 207198 - protein, 8 aa, Unknown
  Description of Unknown: mammalian sequence
HLPGREAH

SEQ ID NO: 207199 - protein, 8 aa, Unknown
  Description of Unknown: mammalian sequence
YLPDAFGP

SEQ ID NO: 207200 - protein, 21 aa, Unknown
  Description of Unknown: mammalian sequence
LEIKTLLMDEQDHGYALTGDA

SEQ ID NO: 207201 - protein, 7 aa, Unknown
  Description of Unknown: mammalian sequence
VLAMAKV

SEQ ID NO: 207202 - protein, 4 aa, Unknown
  Description of Unknown: mammalian sequence
FAFG

SEQ ID NO: 207203 - protein, 4 aa, Unknown
  Description of Unknown: mammalian sequence
GPNQ

SEQ ID NO: 207204 - protein, 8 aa, Unknown
  Description of Unknown: mammalian sequence
DEINNPSL

SEQ ID NO: 207205 - protein, 24 aa, Unknown
  Description of Unknown: mammalian sequence
VIPAGKLERVDPTTVRQEGPWADP

SEQ ID NO: 207206 - protein, 15 aa, Unknown
  Description of Unknown: mammalian sequence
LGVSSSEVSRVEADS

SEQ ID NO: 207207 - protein, 6 aa, Unknown
  Description of Unknown: mammalian sequence
AIPDFG

SEQ ID NO: 207208 - protein, 6 aa, Unknown
  Description of Unknown: mammalian sequence
VDPAYR

SEQ ID NO: 207209 - protein, 6 aa, Unknown
  Description of Unknown: mammalian sequence
YAPSSP

SEQ ID NO: 207210 - protein, 23 aa, Unknown
  Description of Unknown: mammalian sequence
ATPQMEEDKGPINHPQYPGDVGL

SEQ ID NO: 207211 - protein, 4 aa, Unknown
  Description of Unknown: mammalian sequence
IWEP

SEQ ID NO: 207212 - protein, 6 aa, Unknown
  Description of Unknown: mammalian sequence
RTDIQT

SEQ ID NO: 207213 - protein, 13 aa, Unknown
  Description of Unknown: mammalian sequence
KIPFTANKFEKNY

SEQ ID NO: 207214 - protein, 10 aa, Unknown
  Description of Unknown: mammalian sequence
LEGDKNALNQ

SEQ ID NO: 207215 - protein, 4 aa, Unknown
  Description of Unknown: mammalian sequence
AGGD

SEQ ID NO: 207216 - protein, 4 aa, Unknown
  Description of Unknown: mammalian sequence
KADV

SEQ ID NO: 207217 - protein, 4 aa, Unknown
  Description of Unknown: mammalian sequence
KGGR

SEQ ID NO: 207218 - protein, 4 aa, Unknown
  Description of Unknown: mammalian sequence
LGTF

SEQ ID NO: 207219 - protein, 4 aa, Unknown
  Description of Unknown: mammalian sequence
LPFL

SEQ ID NO: 207220 - protein, 4 aa, Unknown
  Description of Unknown: mammalian sequence
QKGK

SEQ ID NO: 207221 - protein, 5 aa, Unknown
  Description of Unknown: mammalian sequence
EEKCE

SEQ ID NO: 207222 - protein, 5 aa, Unknown
  Description of Unknown: mammalian sequence
LGAGD

SEQ ID NO: 207223 - protein, 5 aa, Unknown
  Description of Unknown: mammalian sequence
LKSIE

SEQ ID NO: 207224 - protein, 5 aa, Unknown
  Description of Unknown: mammalian sequence
PKTDD

SEQ ID NO: 207225 - protein, 5 aa, Unknown
  Description of Unknown: mammalian sequence
SAFGS

SEQ ID NO: 207226 - protein, 5 aa, Unknown
  Description of Unknown: mammalian sequence
VLRDP

SEQ ID NO: 207227 - protein, 6 aa, Unknown
  Description of Unknown: mammalian sequence
EEGYKA

SEQ ID NO: 207228 - protein, 6 aa, Unknown
  Description of Unknown: mammalian sequence
KDLGVK

SEQ ID NO: 207229 - protein, 6 aa, Unknown
  Description of Unknown: mammalian sequence
LVDISV

SEQ ID NO: 207230 - protein, 6 aa, Unknown
  Description of Unknown: mammalian sequence
NIRAVP

SEQ ID NO: 207231 - protein, 6 aa, Unknown
  Description of Unknown: mammalian sequence
RCGARR

SEQ ID NO: 207232 - protein, 6 aa, Unknown
  Description of Unknown: mammalian sequence
VFRKGF

SEQ ID NO: 207233 - protein, 6 aa, Unknown
  Description of Unknown: mammalian sequence
VIGKAL

SEQ ID NO: 207234 - protein, 7 aa, Unknown
  Description of Unknown: mammalian sequence
IGIGLPE

SEQ ID NO: 207235 - protein, 7 aa, Unknown
  Description of Unknown: mammalian sequence
QDETGKW

SEQ ID NO: 207236 - protein, 7 aa, Unknown
  Description of Unknown: mammalian sequence
VGMANTT

SEQ ID NO: 207237 - protein, 8 aa, Unknown
  Description of Unknown: mammalian sequence
ELSNIEQV

SEQ ID NO: 207238 - protein, 10 aa, Unknown
  Description of Unknown: mammalian sequence
FQGLTQDQGF

SEQ ID NO: 207239 - protein, 12 aa, Unknown
  Description of Unknown: mammalian sequence
CGKSLSENEITL

SEQ ID NO: 207240 - protein, 14 aa, Unknown
  Description of Unknown: mammalian sequence
LQGWDGQSPGTESH

SEQ ID NO: 207241 - protein, 17 aa, Unknown
  Description of Unknown: mammalian sequence
PVPRIAELMGKKLPNFG

SEQ ID NO: 207242 - protein, 18 aa, Unknown
  Description of Unknown: mammalian sequence
QYGASVSAKPELPLFYTP

SEQ ID NO: 207243 - protein, 18 aa, Unknown
  Description of Unknown: mammalian sequence
SKAGMCACHSPLPSIRGA

SEQ ID NO: 207244 - protein, 23 aa, Unknown
  Description of Unknown: mammalian sequence
EQNAAFPPLERKPFIPKKPIPAI

SEQ ID NO: 207245 - protein, 28 aa, Unknown
  Description of Unknown: mammalian sequence
EALSPIKFNRWDLPEVDPETMQTSEPWV

SEQ ID NO: 207246 - protein, 7 aa, Unknown
  Description of Unknown: mammalian sequence
NTGSGKR

SEQ ID NO: 207247 - protein, 7 aa, Unknown
  Description of Unknown: mammalian sequence
TQPVQSS

SEQ ID NO: 207248 - protein, 7 aa, Unknown
  Description of Unknown: mammalian sequence
YTGDNCA

SEQ ID NO: 207249 - protein, 18 aa, Unknown
  Description of Unknown: mammalian sequence
LPRDGLKDPQGKPLHYDR

SEQ ID NO: 207250 - protein, 7 aa, Unknown
  Description of Unknown: mammalian sequence
DDDRIKD

SEQ ID NO: 207251 - protein, 7 aa, Unknown
  Description of Unknown: mammalian sequence
EAEKNQQ

SEQ ID NO: 207252 - protein, 11 aa, Unknown
  Description of Unknown: mammalian sequence
NHLGIDLGETP

SEQ ID NO: 207253 - protein, 13 aa, Unknown
  Description of Unknown: mammalian sequence
RLFESSGCAGKLA

SEQ ID NO: 207254 - protein, 13 aa, Unknown
  Description of Unknown: mammalian sequence
VRHDGRHAHDYDY

SEQ ID NO: 207255 - protein, 15 aa, Unknown
  Description of Unknown: mammalian sequence
RDIEADTPARYNADP

SEQ ID NO: 207256 - protein, 4 aa, Unknown
  Description of Unknown: mammalian sequence
LSSR

SEQ ID NO: 207257 - protein, 4 aa, Unknown
  Description of Unknown: mammalian sequence
SILM

SEQ ID NO: 207258 - protein, 5 aa, Unknown
  Description of Unknown: mammalian sequence
DTSGG

SEQ ID NO: 207259 - protein, 5 aa, Unknown
  Description of Unknown: mammalian sequence
LGDGA

SEQ ID NO: 207260 - protein, 6 aa, Unknown
  Description of Unknown: mammalian sequence
ANNSTL

SEQ ID NO: 207261 - protein, 6 aa, Unknown
  Description of Unknown: mammalian sequence
IDEIQK

SEQ ID NO: 207262 - protein, 6 aa, Unknown
  Description of Unknown: mammalian sequence
KLPSFE

SEQ ID NO: 207263 - protein, 6 aa, Unknown
  Description of Unknown: mammalian sequence
QEVSQC

SEQ ID NO: 207264 - protein, 6 aa, Unknown
  Description of Unknown: mammalian sequence
RSLSTT

SEQ ID NO: 207265 - protein, 6 aa, Unknown
  Description of Unknown: mammalian sequence
SSNHKL

SEQ ID NO: 207266 - protein, 6 aa, Unknown
  Description of Unknown: mammalian sequence
TFESSH

SEQ ID NO: 207267 - protein, 7 aa, Unknown
  Description of Unknown: mammalian sequence
TALRPSA

SEQ ID NO: 207268 - protein, 8 aa, Unknown
  Description of Unknown: mammalian sequence
PLYESPRK

SEQ ID NO: 207269 - protein, 9 aa, Unknown
  Description of Unknown: mammalian sequence
LNSDGYPDS

SEQ ID NO: 207270 - protein, 9 aa, Unknown
  Description of Unknown: mammalian sequence
LWTDISARI

SEQ ID NO: 207271 - protein, 11 aa, Unknown
  Description of Unknown: mammalian sequence
HKEMLGGEIIP

SEQ ID NO: 207272 - protein, 12 aa, Unknown
  Description of Unknown: mammalian sequence
TLGTQPTVLRTF

SEQ ID NO: 207273 - protein, 12 aa, Unknown
  Description of Unknown: mammalian sequence
VFSNVNLKEVNY

SEQ ID NO: 207274 - protein, 13 aa, Unknown
  Description of Unknown: mammalian sequence
NVFACSDRPTVIY

SEQ ID NO: 207275 - protein, 14 aa, Unknown
  Description of Unknown: mammalian sequence
DITPLGDSNGLSPL

SEQ ID NO: 207276 - protein, 14 aa, Unknown
  Description of Unknown: mammalian sequence
FGLNIETGLLSDRK

SEQ ID NO: 207277 - protein, 29 aa, Unknown
  Description of Unknown: mammalian sequence
TQALSSSVSSSKLFSSSTAPHETSFGEEV

SEQ ID NO: 207278 - protein, 4 aa, Unknown
  Description of Unknown: mammalian sequence
EHGV

SEQ ID NO: 207279 - protein, 4 aa, Unknown
  Description of Unknown: mammalian sequence
REGK

SEQ ID NO: 207280 - protein, 5 aa, Unknown
  Description of Unknown: mammalian sequence
TVLHA

SEQ ID NO: 207281 - protein, 6 aa, Unknown
  Description of Unknown: mammalian sequence
ETEKTG

SEQ ID NO: 207282 - protein, 6 aa, Unknown
  Description of Unknown: mammalian sequence
FHYEGG

SEQ ID NO: 207283 - protein, 6 aa, Unknown
  Description of Unknown: mammalian sequence
LDSGVS

SEQ ID NO: 207284 - protein, 6 aa, Unknown
  Description of Unknown: mammalian sequence
PQAPLA

SEQ ID NO: 207285 - protein, 7 aa, Unknown
  Description of Unknown: mammalian sequence
DKRDGKE

SEQ ID NO: 207286 - protein, 8 aa, Unknown
  Description of Unknown: mammalian sequence
IHPEEGVS

SEQ ID NO: 207287 - protein, 14 aa, Unknown
  Description of Unknown: mammalian sequence
PSLETFTNVTEFEY

SEQ ID NO: 207288 - protein, 19 aa, Unknown
  Description of Unknown: mammalian sequence
GGKFDDNSYKVSGGLHGVG

SEQ ID NO: 207289 - protein, 5 aa, Unknown
  Description of Unknown: mammalian sequence
MKPEN

SEQ ID NO: 207290 - protein, 6 aa, Unknown
  Description of Unknown: mammalian sequence
TNISRA

SEQ ID NO: 207291 - protein, 7 aa, Unknown
  Description of Unknown: mammalian sequence
LLESGRL

SEQ ID NO: 207292 - protein, 15 aa, Unknown
  Description of Unknown: mammalian sequence
VWGTKGLANEGKVIG

SEQ ID NO: 207293 - protein, 28 aa, Unknown
  Description of Unknown: mammalian sequence
TLSQWGFFSPYGIGDNDACTINPYDGWA

SEQ ID NO: 207294 - protein, 4 aa, Unknown
  Description of Unknown: mammalian sequence
MERE

SEQ ID NO: 207295 - protein, 7 aa, Unknown
  Description of Unknown: mammalian sequence
FIDKPGI

SEQ ID NO: 207296 - protein, 8 aa, Unknown
  Description of Unknown: mammalian sequence
TLNYTCPT

SEQ ID NO: 207297 - protein, 10 aa, Unknown
  Description of Unknown: mammalian sequence
LLQERQDNLL

SEQ ID NO: 207298 - protein, 12 aa, Unknown
  Description of Unknown: mammalian sequence
QRTTLPHIRSIT

SEQ ID NO: 207299 - protein, 4 aa, Unknown
  Description of Unknown: mammalian sequence
VGGF

SEQ ID NO: 207300 - protein, 5 aa, Unknown
  Description of Unknown: mammalian sequence
AKIQI

SEQ ID NO: 207301 - protein, 5 aa, Unknown
  Description of Unknown: mammalian sequence
KEQNK

SEQ ID NO: 207302 - protein, 7 aa, Unknown
  Description of Unknown: mammalian sequence
PGPKCPF

SEQ ID NO: 207303 - protein, 9 aa, Unknown
  Description of Unknown: mammalian sequence
QLNYISIAS

SEQ ID NO: 207304 - protein, 9 aa, Unknown
  Description of Unknown: mammalian sequence
SANNIAKYD

SEQ ID NO: 207305 - protein, 16 aa, Unknown
  Description of Unknown: mammalian sequence
AIKGNIDAPQVVEGEK

SEQ ID NO: 207306 - protein, 18 aa, Unknown
  Description of Unknown: mammalian sequence
VIPQGRSHPVQPYPGAFV

SEQ ID NO: 207307 - protein, 4 aa, Unknown
  Description of Unknown: mammalian sequence
ETSR

SEQ ID NO: 207308 - protein, 5 aa, Unknown
  Description of Unknown: mammalian sequence
GVGRR

SEQ ID NO: 207309 - protein, 6 aa, Unknown
  Description of Unknown: mammalian sequence
FFLGQI

SEQ ID NO: 207310 - protein, 6 aa, Unknown
  Description of Unknown: mammalian sequence
LEGSSL

SEQ ID NO: 207311 - protein, 8 aa, Unknown
  Description of Unknown: mammalian sequence
DLSQVNEL

SEQ ID NO: 207312 - protein, 8 aa, Unknown
  Description of Unknown: mammalian sequence
KNANGDYF

SEQ ID NO: 207313 - protein, 11 aa, Unknown
  Description of Unknown: mammalian sequence
ILPLPYPNSPV

SEQ ID NO: 207314 - protein, 12 aa, Unknown
  Description of Unknown: mammalian sequence
FADPTIQSQSEI

SEQ ID NO: 207315 - protein, 13 aa, Unknown
  Description of Unknown: mammalian sequence
CGPYFANDNFSLE

SEQ ID NO: 207316 - protein, 15 aa, Unknown
  Description of Unknown: mammalian sequence
PDSPTYDKFLNPESL

SEQ ID NO: 207317 - protein, 4 aa, Unknown
  Description of Unknown: mammalian sequence
TGDL

SEQ ID NO: 207318 - protein, 6 aa, Unknown
  Description of Unknown: mammalian sequence
FDNEYE

SEQ ID NO: 207319 - protein, 7 aa, Unknown
  Description of Unknown: mammalian sequence
SLKFEGD

SEQ ID NO: 207320 - protein, 13 aa, Unknown
  Description of Unknown: mammalian sequence
VFNPEGRDLITDW

SEQ ID NO: 207321 - protein, 15 aa, Unknown
  Description of Unknown: mammalian sequence
GGNYDINSHLPLIPE

SEQ ID NO: 207322 - protein, 5 aa, Unknown
  Description of Unknown: mammalian sequence
RNEQD

SEQ ID NO: 207323 - protein, 4 aa, Unknown
  Description of Unknown: mammalian sequence
KEGK

SEQ ID NO: 207324 - protein, 5 aa, Unknown
  Description of Unknown: mammalian sequence
MEQAM

SEQ ID NO: 207325 - protein, 6 aa, Unknown
  Description of Unknown: mammalian sequence
ILRVNV

SEQ ID NO: 207326 - protein, 7 aa, Unknown
  Description of Unknown: mammalian sequence
LPDGEDP

SEQ ID NO: 207327 - protein, 7 aa, Unknown
  Description of Unknown: mammalian sequence
LSIGIRR

SEQ ID NO: 207328 - protein, 8 aa, Unknown
  Description of Unknown: mammalian sequence
DNAEPNRL

SEQ ID NO: 207329 - protein, 17 aa, Unknown
  Description of Unknown: mammalian sequence
GFVRKAILASFPEGVGI

SEQ ID NO: 207330 - protein, 4 aa, Unknown
  Description of Unknown: mammalian sequence
VDGV

SEQ ID NO: 207331 - protein, 5 aa, Unknown
  Description of Unknown: mammalian sequence
LWNGG

SEQ ID NO: 207332 - protein, 5 aa, Unknown
  Description of Unknown: mammalian sequence
RGISK

SEQ ID NO: 207333 - protein, 7 aa, Unknown
  Description of Unknown: mammalian sequence
CYVCEKW

SEQ ID NO: 207334 - protein, 7 aa, Unknown
  Description of Unknown: mammalian sequence
RDQNGNI

SEQ ID NO: 207335 - protein, 8 aa, Unknown
  Description of Unknown: mammalian sequence
RDKDKNFK

SEQ ID NO: 207336 - protein, 8 aa, Unknown
  Description of Unknown: mammalian sequence
TAGNEDTK

SEQ ID NO: 207337 - protein, 9 aa, Unknown
  Description of Unknown: mammalian sequence
ESNGRYSAL

SEQ ID NO: 207338 - protein, 11 aa, Unknown
  Description of Unknown: mammalian sequence
GSHKSDALFGK

SEQ ID NO: 207339 - protein, 18 aa, Unknown
  Description of Unknown: mammalian sequence
SKRKPSGGKPGTYNVWNF

SEQ ID NO: 207340 - protein, 4 aa, Unknown
  Description of Unknown: mammalian sequence
FYNM

SEQ ID NO: 207341 - protein, 4 aa, Unknown
  Description of Unknown: mammalian sequence
KFTW

SEQ ID NO: 207342 - protein, 6 aa, Unknown
  Description of Unknown: mammalian sequence
FITPII

SEQ ID NO: 207343 - protein, 6 aa, Unknown
  Description of Unknown: mammalian sequence
FSKKKA

SEQ ID NO: 207344 - protein, 7 aa, Unknown
  Description of Unknown: mammalian sequence
SNLDRHL

SEQ ID NO: 207345 - protein, 8 aa, Unknown
  Description of Unknown: mammalian sequence
FHSLQGND

SEQ ID NO: 207346 - protein, 8 aa, Unknown
  Description of Unknown: mammalian sequence
ITKPTKNT

SEQ ID NO: 207347 - protein, 10 aa, Unknown
  Description of Unknown: mammalian sequence
YYKGLGTSLA

SEQ ID NO: 207348 - protein, 14 aa, Unknown
  Description of Unknown: mammalian sequence
QYEPGTVLDPTLKE

SEQ ID NO: 207349 - protein, 6 aa, Unknown
  Description of Unknown: mammalian sequence
LNPSSR

SEQ ID NO: 207350 - protein, 8 aa, Unknown
  Description of Unknown: mammalian sequence
QRAPPKTF

SEQ ID NO: 207351 - protein, 12 aa, Unknown
  Description of Unknown: mammalian sequence
ADAKVMKDAKTK

SEQ ID NO: 207352 - protein, 4 aa, Unknown
  Description of Unknown: mammalian sequence
LNGN

SEQ ID NO: 207353 - protein, 5 aa, Unknown
  Description of Unknown: mammalian sequence
AGEME

SEQ ID NO: 207354 - protein, 6 aa, Unknown
  Description of Unknown: mammalian sequence
MDNMGR

SEQ ID NO: 207355 - protein, 6 aa, Unknown
  Description of Unknown: mammalian sequence
SREYKK

SEQ ID NO: 207356 - protein, 6 aa, Unknown
  Description of Unknown: mammalian sequence
STKDVK

SEQ ID NO: 207357 - protein, 7 aa, Unknown
  Description of Unknown: mammalian sequence
KLPVKGF

SEQ ID NO: 207358 - protein, 7 aa, Unknown
  Description of Unknown: mammalian sequence
PFNGEDY

SEQ ID NO: 207359 - protein, 8 aa, Unknown
  Description of Unknown: mammalian sequence
FKMQSLDK

SEQ ID NO: 207360 - protein, 4 aa, Unknown
  Description of Unknown: mammalian sequence
TPEG

SEQ ID NO: 207361 - protein, 5 aa, Unknown
  Description of Unknown: mammalian sequence
VGPLK

SEQ ID NO: 207362 - protein, 6 aa, Unknown
  Description of Unknown: mammalian sequence
ETDADF

SEQ ID NO: 207363 - protein, 8 aa, Unknown
  Description of Unknown: mammalian sequence
IPEEDGSS

SEQ ID NO: 207364 - protein, 9 aa, Unknown
  Description of Unknown: mammalian sequence
DCTKLGTGA

SEQ ID NO: 207365 - protein, 10 aa, Unknown
  Description of Unknown: mammalian sequence
NIPNDVTKLN

SEQ ID NO: 207366 - protein, 15 aa, Unknown
  Description of Unknown: mammalian sequence
GAARPGLRLPGCVDA

SEQ ID NO: 207367 - protein, 12 aa, Unknown
  Description of Unknown: mammalian sequence
RLRRNDDEPAEM

SEQ ID NO: 207368 - protein, 4 aa, Unknown
  Description of Unknown: mammalian sequence
LDQR

SEQ ID NO: 207369 - protein, 5 aa, Unknown
  Description of Unknown: mammalian sequence
VDGNR

SEQ ID NO: 207370 - protein, 6 aa, Unknown
  Description of Unknown: mammalian sequence
PLRRFY

SEQ ID NO: 207371 - protein, 6 aa, Unknown
  Description of Unknown: mammalian sequence
YAEEDG

SEQ ID NO: 207372 - protein, 6 aa, Unknown
  Description of Unknown: mammalian sequence
YEDGRL

SEQ ID NO: 207373 - protein, 7 aa, Unknown
  Description of Unknown: mammalian sequence
RSNQGTA

SEQ ID NO: 207374 - protein, 10 aa, Unknown
  Description of Unknown: mammalian sequence
DGPASENGFL

SEQ ID NO: 207375 - protein, 14 aa, Unknown
  Description of Unknown: mammalian sequence
PRVVVGQRVRKGDL

SEQ ID NO: 207376 - protein, 16 aa, Unknown
  Description of Unknown: mammalian sequence
ELITNIGETAGVVQDI

SEQ ID NO: 207377 - protein, 20 aa, Unknown
  Description of Unknown: mammalian sequence
SDPTLPRSDRECPKCHSREN

SEQ ID NO: 207378 - protein, 5 aa, Unknown
  Description of Unknown: mammalian sequence
VEGEV

SEQ ID NO: 207379 - protein, 8 aa, Unknown
  Description of Unknown: mammalian sequence
YVPVVQEV

SEQ ID NO: 207380 - protein, 4 aa, Unknown
  Description of Unknown: mammalian sequence
YQNN

SEQ ID NO: 207381 - protein, 5 aa, Unknown
  Description of Unknown: mammalian sequence
LVVNI

SEQ ID NO: 207382 - protein, 6 aa, Unknown
  Description of Unknown: mammalian sequence
EKNFQT

SEQ ID NO: 207383 - protein, 11 aa, Unknown
  Description of Unknown: mammalian sequence
MKLVPSIPPAT

SEQ ID NO: 207384 - protein, 14 aa, Unknown
  Description of Unknown: mammalian sequence
TQPDVPFKNPDNVV

SEQ ID NO: 207385 - protein, 32 aa, Unknown
  Description of Unknown: mammalian sequence
YPEDHNEPQSVRAASSDPGEVVPSACAADEPV

SEQ ID NO: 207386 - protein, 4 aa, Unknown
  Description of Unknown: mammalian sequence
ALCL

SEQ ID NO: 207387 - protein, 4 aa, Unknown
  Description of Unknown: mammalian sequence
LLSL

SEQ ID NO: 207388 - protein, 7 aa, Unknown
  Description of Unknown: mammalian sequence
LNNVRFS

SEQ ID NO: 207389 - protein, 7 aa, Unknown
  Description of Unknown: mammalian sequence
SLCKAHL

SEQ ID NO: 207390 - protein, 8 aa, Unknown
  Description of Unknown: mammalian sequence
EHNNLVNV

SEQ ID NO: 207391 - protein, 8 aa, Unknown
  Description of Unknown: mammalian sequence
YDTGRTGR

SEQ ID NO: 207392 - protein, 11 aa, Unknown
  Description of Unknown: mammalian sequence
QHNLKQNDQPQ

SEQ ID NO: 207393 - protein, 11 aa, Unknown
  Description of Unknown: mammalian sequence
LYPNAQTGHGH

SEQ ID NO: 207394 - protein, 13 aa, Unknown
  Description of Unknown: mammalian sequence
AEVTYKHHEPTGC

SEQ ID NO: 207395 - protein, 4 aa, Unknown
  Description of Unknown: mammalian sequence
MITP

SEQ ID NO: 207396 - protein, 8 aa, Unknown
  Description of Unknown: mammalian sequence
LQHPKIIK

SEQ ID NO: 207397 - protein, 12 aa, Unknown
  Description of Unknown: mammalian sequence
REDEEMGLTTTS

SEQ ID NO: 207398 - protein, 5 aa, Unknown
  Description of Unknown: mammalian sequence
GSREE

SEQ ID NO: 207399 - protein, 4 aa, Unknown
  Description of Unknown: mammalian sequence
ENTC

SEQ ID NO: 207400 - protein, 11 aa, Unknown
  Description of Unknown: mammalian sequence
PVSGAKTFKNE

SEQ ID NO: 207401 - protein, 5 aa, Unknown
  Description of Unknown: mammalian sequence
LSQDD

SEQ ID NO: 207402 - protein, 8 aa, Unknown
  Description of Unknown: mammalian sequence
LLGADDDL

SEQ ID NO: 207403 - protein, 4 aa, Unknown
  Description of Unknown: mammalian sequence
GHGE

SEQ ID NO: 207404 - protein, 4 aa, Unknown
  Description of Unknown: mammalian sequence
PKGR

SEQ ID NO: 207405 - protein, 5 aa, Unknown
  Description of Unknown: mammalian sequence
ALPSP

SEQ ID NO: 207406 - protein, 6 aa, Unknown
  Description of Unknown: mammalian sequence
DYGVEV

SEQ ID NO: 207407 - protein, 6 aa, Unknown
  Description of Unknown: mammalian sequence
EDPSLK

SEQ ID NO: 207408 - protein, 7 aa, Unknown
  Description of Unknown: mammalian sequence
FGDGPPL

SEQ ID NO: 207409 - protein, 8 aa, Unknown
  Description of Unknown: mammalian sequence
RQEETGEL

SEQ ID NO: 207410 - protein, 8 aa, Unknown
  Description of Unknown: mammalian sequence
SVPKVPYR

SEQ ID NO: 207411 - protein, 8 aa, Unknown
  Description of Unknown: mammalian sequence
WQGEKPES

SEQ ID NO: 207412 - protein, 12 aa, Unknown
  Description of Unknown: mammalian sequence
EVPFARLPDPNV

SEQ ID NO: 207413 - protein, 4 aa, Unknown
  Description of Unknown: mammalian sequence
DIYV

SEQ ID NO: 207414 - protein, 6 aa, Unknown
  Description of Unknown: mammalian sequence
IGENIN

SEQ ID NO: 207415 - protein, 7 aa, Unknown
  Description of Unknown: mammalian sequence
AGKITDV

SEQ ID NO: 207416 - protein, 8 aa, Unknown
  Description of Unknown: mammalian sequence
KAGNVAAD

SEQ ID NO: 207417 - protein, 14 aa, Unknown
  Description of Unknown: mammalian sequence
YIPVPTRDLEKPFL

SEQ ID NO: 207418 - protein, 4 aa, Unknown
  Description of Unknown: mammalian sequence
GEHI

SEQ ID NO: 207419 - protein, 4 aa, Unknown
  Description of Unknown: mammalian sequence
EGPE

SEQ ID NO: 207420 - protein, 4 aa, Unknown
  Description of Unknown: mammalian sequence
FEWT

SEQ ID NO: 207421 - protein, 4 aa, Unknown
  Description of Unknown: mammalian sequence
KATY

SEQ ID NO: 207422 - protein, 4 aa, Unknown
  Description of Unknown: mammalian sequence
KDGV

SEQ ID NO: 207423 - protein, 4 aa, Unknown
  Description of Unknown: mammalian sequence
LLGS

SEQ ID NO: 207424 - protein, 4 aa, Unknown
  Description of Unknown: mammalian sequence
VSKS

SEQ ID NO: 207425 - protein, 7 aa, Unknown
  Description of Unknown: mammalian sequence
KAPDGRI

SEQ ID NO: 207426 - protein, 8 aa, Unknown
  Description of Unknown: mammalian sequence
RKASNKAY

SEQ ID NO: 207427 - protein, 10 aa, Unknown
  Description of Unknown: mammalian sequence
YAPILYENDH

SEQ ID NO: 207428 - protein, 4 aa, Unknown
  Description of Unknown: mammalian sequence
YSLG

SEQ ID NO: 207429 - protein, 6 aa, Unknown
  Description of Unknown: mammalian sequence
LDPQWS

SEQ ID NO: 207430 - protein, 7 aa, Unknown
  Description of Unknown: mammalian sequence
REGNGPT

SEQ ID NO: 207431 - protein, 7 aa, Unknown
  Description of Unknown: mammalian sequence
RGEQVAF

SEQ ID NO: 207432 - protein, 8 aa, Unknown
  Description of Unknown: mammalian sequence
QQPHGPYY

SEQ ID NO: 207433 - protein, 11 aa, Unknown
  Description of Unknown: mammalian sequence
LDTWPPETQNW

SEQ ID NO: 207434 - protein, 13 aa, Unknown
  Description of Unknown: mammalian sequence
CFHPASGFAWQFS

SEQ ID NO: 207435 - protein, 16 aa, Unknown
  Description of Unknown: mammalian sequence
GIQSPRPNGPMQTAAN

SEQ ID NO: 207436 - protein, 17 aa, Unknown
  Description of Unknown: mammalian sequence
IDAEEDSTRRMGFETIL

SEQ ID NO: 207437 - protein, 22 aa, Unknown
  Description of Unknown: mammalian sequence
EMPDAPLQPGWDRPETPYSPPL

SEQ ID NO: 207438 - protein, 6 aa, Unknown
  Description of Unknown: mammalian sequence
LLDAPV

SEQ ID NO: 207439 - protein, 5 aa, Unknown
  Description of Unknown: mammalian sequence
EHIDL

SEQ ID NO: 207440 - protein, 5 aa, Unknown
  Description of Unknown: mammalian sequence
FGCDK

SEQ ID NO: 207441 - protein, 7 aa, Unknown
  Description of Unknown: mammalian sequence
CDCKHTT

SEQ ID NO: 207442 - protein, 9 aa, Unknown
  Description of Unknown: mammalian sequence
LNGNDNTIK

SEQ ID NO: 207443 - protein, 10 aa, Unknown
  Description of Unknown: mammalian sequence
ISENKNDAKV

SEQ ID NO: 207444 - protein, 8 aa, Unknown
  Description of Unknown: mammalian sequence
TAACTNTS

SEQ ID NO: 207445 - protein, 4 aa, Unknown
  Description of Unknown: mammalian sequence
LTLL

SEQ ID NO: 207446 - protein, 12 aa, Unknown
  Description of Unknown: mammalian sequence
DWENWQNVGQWR

SEQ ID NO: 207447 - protein, 8 aa, Unknown
  Description of Unknown: mammalian sequence
STKNPVHA

SEQ ID NO: 207448 - protein, 5 aa, Unknown
  Description of Unknown: mammalian sequence
THRNK

SEQ ID NO: 207449 - protein, 12 aa, Unknown
  Description of Unknown: mammalian sequence
IDHVLGVPYTTV

SEQ ID NO: 207450 - protein, 4 aa, Unknown
  Description of Unknown: mammalian sequence
IDGR

SEQ ID NO: 207451 - protein, 4 aa, Unknown
  Description of Unknown: mammalian sequence
KGTQ

SEQ ID NO: 207452 - protein, 5 aa, Unknown
  Description of Unknown: mammalian sequence
ETIKG

SEQ ID NO: 207453 - protein, 6 aa, Unknown
  Description of Unknown: mammalian sequence
ECSSES

SEQ ID NO: 207454 - protein, 7 aa, Unknown
  Description of Unknown: mammalian sequence
LDPTKTI

SEQ ID NO: 207455 - protein, 8 aa, Unknown
  Description of Unknown: mammalian sequence
SKPEAEET

SEQ ID NO: 207456 - protein, 10 aa, Unknown
  Description of Unknown: mammalian sequence
ETAVTQTYGG

SEQ ID NO: 207457 - protein, 11 aa, Unknown
  Description of Unknown: mammalian sequence
FCTDHTVLVQT

SEQ ID NO: 207458 - protein, 4 aa, Unknown
  Description of Unknown: mammalian sequence
SGGT

SEQ ID NO: 207459 - protein, 6 aa, Unknown
  Description of Unknown: mammalian sequence
FNENGI

SEQ ID NO: 207460 - protein, 6 aa, Unknown
  Description of Unknown: mammalian sequence
SFLNSM

SEQ ID NO: 207461 - protein, 7 aa, Unknown
  Description of Unknown: mammalian sequence
QNTGANN

SEQ ID NO: 207462 - protein, 9 aa, Unknown
  Description of Unknown: mammalian sequence
QNGYKPGDL

SEQ ID NO: 207463 - protein, 12 aa, Unknown
  Description of Unknown: mammalian sequence
TTGTINGATAAT

SEQ ID NO: 207464 - protein, 15 aa, Unknown
  Description of Unknown: mammalian sequence
DSSDPAATAPTTAST

SEQ ID NO: 207465 - protein, 11 aa, Unknown
  Description of Unknown: mammalian sequence
AEQPGGWKGWR

SEQ ID NO: 207466 - protein, 7 aa, Unknown
  Description of Unknown: mammalian sequence
VYRFDKE

SEQ ID NO: 207467 - protein, 4 aa, Unknown
  Description of Unknown: mammalian sequence
DAHG

SEQ ID NO: 207468 - protein, 4 aa, Unknown
  Description of Unknown: mammalian sequence
KGAL

SEQ ID NO: 207469 - protein, 5 aa, Unknown
  Description of Unknown: mammalian sequence
RGVEW

SEQ ID NO: 207470 - protein, 6 aa, Unknown
  Description of Unknown: mammalian sequence
VTDHDW

SEQ ID NO: 207471 - protein, 7 aa, Unknown
  Description of Unknown: mammalian sequence
SGLEVSE

SEQ ID NO: 207472 - protein, 8 aa, Unknown
  Description of Unknown: mammalian sequence
LPLPLVPQ

SEQ ID NO: 207473 - protein, 8 aa, Unknown
  Description of Unknown: mammalian sequence
VGEPEMPS

SEQ ID NO: 207474 - protein, 9 aa, Unknown
  Description of Unknown: mammalian sequence
SAILPGRFQ

SEQ ID NO: 207475 - protein, 18 aa, Unknown
  Description of Unknown: mammalian sequence
QGKCKKTCRDVFCPGSST

SEQ ID NO: 207476 - protein, 4 aa, Unknown
  Description of Unknown: mammalian sequence
EEGL

SEQ ID NO: 207477 - protein, 4 aa, Unknown
  Description of Unknown: mammalian sequence
FAGY

SEQ ID NO: 207478 - protein, 6 aa, Unknown
  Description of Unknown: mammalian sequence
NKETRK

SEQ ID NO: 207479 - protein, 7 aa, Unknown
  Description of Unknown: mammalian sequence
EKELYFK

SEQ ID NO: 207480 - protein, 7 aa, Unknown
  Description of Unknown: mammalian sequence
FQGKIKG

SEQ ID NO: 207481 - protein, 7 aa, Unknown
  Description of Unknown: mammalian sequence
MWPDADL

SEQ ID NO: 207482 - protein, 7 aa, Unknown
  Description of Unknown: mammalian sequence
VGEGFAF

SEQ ID NO: 207483 - protein, 10 aa, Unknown
  Description of Unknown: mammalian sequence
GTARASIPTY

SEQ ID NO: 207484 - protein, 13 aa, Unknown
  Description of Unknown: mammalian sequence
FTPVSKDPQSANW

SEQ ID NO: 207485 - protein, 13 aa, Unknown
  Description of Unknown: mammalian sequence
YLPKGEDGKDYSW

SEQ ID NO: 207486 - protein, 22 aa, Unknown
  Description of Unknown: mammalian sequence
WGFERDENGNPKRDETLKHPRC

SEQ ID NO: 207487 - protein, 55 aa, Unknown
  Description of Unknown: mammalian sequence
AYLYGPGREDGPLPEYYEPMECPVIEHPFSKTLHNPTALHFATEEKAVCDPRYPF

SEQ ID NO: 207488 - protein, 44 aa, Unknown
  Description of Unknown: mammalian sequence
GRLFAINKMAEGPFPEHYEPIETPLGTNPLHPNVVSNPVVRLYE

SEQ ID NO: 207489 - protein, 4 aa, Unknown
  Description of Unknown: mammalian sequence
AAQK

SEQ ID NO: 207490 - protein, 4 aa, Unknown
  Description of Unknown: mammalian sequence
EDGL

SEQ ID NO: 207491 - protein, 4 aa, Unknown
  Description of Unknown: mammalian sequence
FSGY

SEQ ID NO: 207492 - protein, 5 aa, Unknown
  Description of Unknown: mammalian sequence
TNASL

SEQ ID NO: 207493 - protein, 6 aa, Unknown
  Description of Unknown: mammalian sequence
DAEKRQ

SEQ ID NO: 207494 - protein, 7 aa, Unknown
  Description of Unknown: mammalian sequence
DEGKVTG

SEQ ID NO: 207495 - protein, 7 aa, Unknown
  Description of Unknown: mammalian sequence
ENNKINA

SEQ ID NO: 207496 - protein, 7 aa, Unknown
  Description of Unknown: mammalian sequence
VRDDFAF

SEQ ID NO: 207497 - protein, 10 aa, Unknown
  Description of Unknown: mammalian sequence
TLPSEKQVDL

SEQ ID NO: 207498 - protein, 11 aa, Unknown
  Description of Unknown: mammalian sequence
WLPKWDQTYDV

SEQ ID NO: 207499 - protein, 12 aa, Unknown
  Description of Unknown: mammalian sequence
ALRMGKKEQFPY

SEQ ID NO: 207500 - protein, 13 aa, Unknown
  Description of Unknown: mammalian sequence
NTPKATLADQVNY

SEQ ID NO: 207501 - protein, 27 aa, Unknown
  Description of Unknown: mammalian sequence
YDKSSWNYQLDENGYAKRDETLTHPRC

SEQ ID NO: 207502 - protein, 9 aa, Unknown
  Description of Unknown: mammalian sequence
HLPATIGDY

SEQ ID NO: 207503 - protein, 4 aa, Unknown
  Description of Unknown: mammalian sequence
SNRG

SEQ ID NO: 207504 - protein, 6 aa, Unknown
  Description of Unknown: mammalian sequence
DAVKGK

SEQ ID NO: 207505 - protein, 7 aa, Unknown
  Description of Unknown: mammalian sequence
LLPDGRV

SEQ ID NO: 207506 - protein, 7 aa, Unknown
  Description of Unknown: mammalian sequence
MDGNGQI

SEQ ID NO: 207507 - protein, 7 aa, Unknown
  Description of Unknown: mammalian sequence
QAGPSTA

SEQ ID NO: 207508 - protein, 7 aa, Unknown
  Description of Unknown: mammalian sequence
SDNHAWL

SEQ ID NO: 207509 - protein, 7 aa, Unknown
  Description of Unknown: mammalian sequence
VLPDGST

SEQ ID NO: 207510 - protein, 7 aa, Unknown
  Description of Unknown: mammalian sequence
YNSNGNL

SEQ ID NO: 207511 - protein, 7 aa, Unknown
  Description of Unknown: mammalian sequence
YTSGSGD

SEQ ID NO: 207512 - protein, 8 aa, Unknown
  Description of Unknown: mammalian sequence
DLPIVPAA

SEQ ID NO: 207513 - protein, 8 aa, Unknown
  Description of Unknown: mammalian sequence
IEPTSGRV

SEQ ID NO: 207514 - protein, 8 aa, Unknown
  Description of Unknown: mammalian sequence
WDPSTGIV

SEQ ID NO: 207515 - protein, 9 aa, Unknown
  Description of Unknown: mammalian sequence
EANGQPWTS

SEQ ID NO: 207516 - protein, 9 aa, Unknown
  Description of Unknown: mammalian sequence
MLTADKQGL

SEQ ID NO: 207517 - protein, 9 aa, Unknown
  Description of Unknown: mammalian sequence
VAPDAMCGN

SEQ ID NO: 207518 - protein, 10 aa, Unknown
  Description of Unknown: mammalian sequence
TLGEPGTSPN

SEQ ID NO: 207519 - protein, 12 aa, Unknown
  Description of Unknown: mammalian sequence
VTVTKHDMFCPG

SEQ ID NO: 207520 - protein, 13 aa, Unknown
  Description of Unknown: mammalian sequence
KQNPNSIVRVYHS

SEQ ID NO: 207521 - protein, 14 aa, Unknown
  Description of Unknown: mammalian sequence
FASNGLYFARTFHT

SEQ ID NO: 207522 - protein, 14 aa, Unknown
  Description of Unknown: mammalian sequence
GGGLCGDCTTNHFD

SEQ ID NO: 207523 - protein, 14 aa, Unknown
  Description of Unknown: mammalian sequence
QASSYTAPQPGLGR

SEQ ID NO: 207524 - protein, 16 aa, Unknown
  Description of Unknown: mammalian sequence
FGGSPDYQDSDATTNA

SEQ ID NO: 207525 - protein, 17 aa, Unknown
  Description of Unknown: mammalian sequence
WSSYRNDAFGGSPGGIT

SEQ ID NO: 207526 - protein, 20 aa, Unknown
  Description of Unknown: mammalian sequence
TGGQRRGIPFEDSTPVFTPE

SEQ ID NO: 207527 - protein, 10 aa, Unknown
  Description of Unknown: mammalian sequence
LIPQHTGTFR

SEQ ID NO: 207528 - protein, 11 aa, Unknown
  Description of Unknown: mammalian sequence
EPRSQPHTKPS

SEQ ID NO: 207529 - protein, 4 aa, Unknown
  Description of Unknown: mammalian sequence
KPAP

SEQ ID NO: 207530 - protein, 6 aa, Unknown
  Description of Unknown: mammalian sequence
IEGANG

SEQ ID NO: 207531 - protein, 8 aa, Unknown
  Description of Unknown: mammalian sequence
PIKNMPID

SEQ ID NO: 207532 - protein, 12 aa, Unknown
  Description of Unknown: mammalian sequence
DQPTAHPTVRDE

SEQ ID NO: 207533 - protein, 8 aa, Unknown
  Description of Unknown: mammalian sequence
LVRTLVPT

SEQ ID NO: 207534 - protein, 9 aa, Unknown
  Description of Unknown: mammalian sequence
AGAPVETPQ

SEQ ID NO: 207535 - protein, 11 aa, Unknown
  Description of Unknown: mammalian sequence
SLDAPATSLTG

SEQ ID NO: 207536 - protein, 12 aa, Unknown
  Description of Unknown: mammalian sequence
YAAGTPLSSPEL

SEQ ID NO: 207537 - protein, 4 aa, Unknown
  Description of Unknown: mammalian sequence
KVEH

SEQ ID NO: 207538 - protein, 4 aa, Unknown
  Description of Unknown: mammalian sequence
SHGQ

SEQ ID NO: 207539 - protein, 4 aa, Unknown
  Description of Unknown: mammalian sequence
VDLS

SEQ ID NO: 207540 - protein, 5 aa, Unknown
  Description of Unknown: mammalian sequence
KGLDA

SEQ ID NO: 207541 - protein, 5 aa, Unknown
  Description of Unknown: mammalian sequence
LGPNA

SEQ ID NO: 207542 - protein, 5 aa, Unknown
  Description of Unknown: mammalian sequence
LTGRI

SEQ ID NO: 207543 - protein, 6 aa, Unknown
  Description of Unknown: mammalian sequence
ITRRSV

SEQ ID NO: 207544 - protein, 6 aa, Unknown
  Description of Unknown: mammalian sequence
VKRQDI

SEQ ID NO: 207545 - protein, 7 aa, Unknown
  Description of Unknown: mammalian sequence
FDKTGAE

SEQ ID NO: 207546 - protein, 17 aa, Unknown
  Description of Unknown: mammalian sequence
ESNLQYDAGDKGIYRHY

SEQ ID NO: 207547 - protein, 5 aa, Unknown
  Description of Unknown: mammalian sequence
DIGTI

SEQ ID NO: 207548 - protein, 27 aa, Unknown
  Description of Unknown: mammalian sequence
TKKPVPDFSFYDRSAPIYTQPRYLPPS

SEQ ID NO: 207549 - protein, 4 aa, Unknown
  Description of Unknown: mammalian sequence
KTPL

SEQ ID NO: 207550 - protein, 7 aa, Unknown
  Description of Unknown: mammalian sequence
NCYGCET

SEQ ID NO: 207551 - protein, 16 aa, Unknown
  Description of Unknown: mammalian sequence
YGIDVKIPEGLEPPNE

SEQ ID NO: 207552 - protein, 6 aa, Unknown
  Description of Unknown: mammalian sequence
VGGFYN

SEQ ID NO: 207553 - protein, 7 aa, Unknown
  Description of Unknown: mammalian sequence
VLTGKAR

SEQ ID NO: 207554 - protein, 14 aa, Unknown
  Description of Unknown: mammalian sequence
FDVAESVIPSSGTF

SEQ ID NO: 207555 - protein, 5 aa, Unknown
  Description of Unknown: mammalian sequence
TLKPW

SEQ ID NO: 207556 - protein, 9 aa, Unknown
  Description of Unknown: mammalian sequence
VQNTTHLDE

SEQ ID NO: 207557 - protein, 11 aa, Unknown
  Description of Unknown: mammalian sequence
LKGEPSDMDKA

SEQ ID NO: 207558 - protein, 14 aa, Unknown
  Description of Unknown: mammalian sequence
HFPAMVSRISGIGL

SEQ ID NO: 207559 - protein, 15 aa, Unknown
  Description of Unknown: mammalian sequence
QVSRGAEHLDDLDLN

SEQ ID NO: 207560 - protein, 26 aa, Unknown
  Description of Unknown: mammalian sequence
LAQVDPGENARYCTLQGRNEVPDTLD

SEQ ID NO: 207561 - protein, 27 aa, Unknown
  Description of Unknown: mammalian sequence
YNEEVVALPVGGFYRFRKSGDRHGWEG

SEQ ID NO: 207562 - protein, 13 aa, Unknown
  Description of Unknown: mammalian sequence
HDPFTLEPYSRDP

SEQ ID NO: 207563 - protein, 13 aa, Unknown
  Description of Unknown: mammalian sequence
YTPAGEPIPTNKR

SEQ ID NO: 207564 - protein, 4 aa, Unknown
  Description of Unknown: mammalian sequence
NIPP

SEQ ID NO: 207565 - protein, 4 aa, Unknown
  Description of Unknown: mammalian sequence
RGWA

SEQ ID NO: 207566 - protein, 5 aa, Unknown
  Description of Unknown: mammalian sequence
AFETP

SEQ ID NO: 207567 - protein, 5 aa, Unknown
  Description of Unknown: mammalian sequence
DELRG

SEQ ID NO: 207568 - protein, 6 aa, Unknown
  Description of Unknown: mammalian sequence
EIPDVV

SEQ ID NO: 207569 - protein, 7 aa, Unknown
  Description of Unknown: mammalian sequence
KGGYDGR

SEQ ID NO: 207570 - protein, 7 aa, Unknown
  Description of Unknown: mammalian sequence
RRGEPHV

SEQ ID NO: 207571 - protein, 8 aa, Unknown
  Description of Unknown: mammalian sequence
LKVPRPGT

SEQ ID NO: 207572 - protein, 14 aa, Unknown
  Description of Unknown: mammalian sequence
NLDGKPLLTGKRNP

SEQ ID NO: 207573 - protein, 6 aa, Unknown
  Description of Unknown: mammalian sequence
DHSDVA

SEQ ID NO: 207574 - protein, 8 aa, Unknown
  Description of Unknown: mammalian sequence
FKPAYGSI

SEQ ID NO: 207575 - protein, 19 aa, Unknown
  Description of Unknown: mammalian sequence
AFPGTPHLLPPANSGDADA

SEQ ID NO: 207576 - protein, 12 aa, Unknown
  Description of Unknown: mammalian sequence
YGKDDKLYPKDP

SEQ ID NO: 207577 - protein, 9 aa, Unknown
  Description of Unknown: mammalian sequence
KYNLYGKDI

SEQ ID NO: 207578 - protein, 6 aa, Unknown
  Description of Unknown: mammalian sequence
LREGNL

SEQ ID NO: 207579 - protein, 6 aa, Unknown
  Description of Unknown: mammalian sequence
DCNEKL

SEQ ID NO: 207580 - protein, 6 aa, Unknown
  Description of Unknown: mammalian sequence
LYPSDP

SEQ ID NO: 207581 - protein, 6 aa, Unknown
  Description of Unknown: mammalian sequence
YGAHDA

SEQ ID NO: 207582 - protein, 9 aa, Unknown
  Description of Unknown: mammalian sequence
QFKMMGETD

SEQ ID NO: 207583 - protein, 6 aa, Unknown
  Description of Unknown: mammalian sequence
FETEYF

SEQ ID NO: 207584 - protein, 11 aa, Unknown
  Description of Unknown: mammalian sequence
TSPHDHQTHAY

SEQ ID NO: 207585 - protein, 9 aa, Unknown
  Description of Unknown: mammalian sequence
KADPKGITE

SEQ ID NO: 207586 - protein, 34 aa, Unknown
  Description of Unknown: mammalian sequence
LTAKEPTEVESVECPHIAVGVWEANEKLPETPDR

SEQ ID NO: 207587 - protein, 4 aa, Unknown
  Description of Unknown: mammalian sequence
VVPN

SEQ ID NO: 207588 - protein, 5 aa, Unknown
  Description of Unknown: mammalian sequence
LSPPV

SEQ ID NO: 207589 - protein, 7 aa, Unknown
  Description of Unknown: mammalian sequence
DVKNGEC

SEQ ID NO: 207590 - protein, 7 aa, Unknown
  Description of Unknown: mammalian sequence
KDDIVDR

SEQ ID NO: 207591 - protein, 7 aa, Unknown
  Description of Unknown: mammalian sequence
SDKKCSV

SEQ ID NO: 207592 - protein, 7 aa, Unknown
  Description of Unknown: mammalian sequence
TKVPLVA

SEQ ID NO: 207593 - protein, 9 aa, Unknown
  Description of Unknown: mammalian sequence
LAQLDNYGQ

SEQ ID NO: 207594 - protein, 12 aa, Unknown
  Description of Unknown: mammalian sequence
NYNVKSPITGND

SEQ ID NO: 207595 - protein, 85 aa, Unknown
  Description of Unknown: mammalian sequence
KPLKEPKTVNVVQFEPSKGAIGKAYKKDAKLVMEYLAICDECYITEMEMLLNEKGEFTIETEGKTFQLTKDMINVKRFQKTLYVE

SEQ ID NO: 207596 - protein, 4 aa, Unknown
  Description of Unknown: mammalian sequence
SNGG

SEQ ID NO: 207597 - protein, 13 aa, Unknown
  Description of Unknown: mammalian sequence
FSVDEIVQPDPPI

SEQ ID NO: 207598 - protein, 10 aa, Unknown
  Description of Unknown: mammalian sequence
LTPRRSRKLK

SEQ ID NO: 207599 - protein, 6 aa, Unknown
  Description of Unknown: mammalian sequence
DEPRSV

SEQ ID NO: 207600 - protein, 29 aa, Unknown
  Description of Unknown: mammalian sequence
LPTANGDGGALALDSLTVLGAGGNNANDW

SEQ ID NO: 207601 - protein, 6 aa, Unknown
  Description of Unknown: mammalian sequence
RNNLTR

SEQ ID NO: 207602 - protein, 8 aa, Unknown
  Description of Unknown: mammalian sequence
RAMTDVHQ

SEQ ID NO: 207603 - protein, 24 aa, Unknown
  Description of Unknown: mammalian sequence
TTENPELQLEPLSAPEVTEPTATD

SEQ ID NO: 207604 - protein, 6 aa, Unknown
  Description of Unknown: mammalian sequence
VPRDCG

SEQ ID NO: 207605 - protein, 7 aa, Unknown
  Description of Unknown: mammalian sequence
VRSRGPE

SEQ ID NO: 207606 - protein, 40 aa, Unknown
  Description of Unknown: mammalian sequence
QEPEFQRMSALRLAACKRKEQEHGKDRGNTPKKPRLVFTD

SEQ ID NO: 207607 - protein, 14 aa, Unknown
  Description of Unknown: mammalian sequence
AEGFGLPEEKGPDL

SEQ ID NO: 207608 - protein, 4 aa, Unknown
  Description of Unknown: mammalian sequence
KGGK

SEQ ID NO: 207609 - protein, 6 aa, Unknown
  Description of Unknown: mammalian sequence
KNQKPI

SEQ ID NO: 207610 - protein, 7 aa, Unknown
  Description of Unknown: mammalian sequence
RGTLNVS

SEQ ID NO: 207611 - protein, 9 aa, Unknown
  Description of Unknown: mammalian sequence
TVGAGLPII

SEQ ID NO: 207612 - protein, 4 aa, Unknown
  Description of Unknown: mammalian sequence
LDGE

SEQ ID NO: 207613 - protein, 4 aa, Unknown
  Description of Unknown: mammalian sequence
LGNW

SEQ ID NO: 207614 - protein, 7 aa, Unknown
  Description of Unknown: mammalian sequence
HLFPDCA

SEQ ID NO: 207615 - protein, 18 aa, Unknown
  Description of Unknown: mammalian sequence
IPKAELLTSESRGVLPDT

SEQ ID NO: 207616 - protein, 5 aa, Unknown
  Description of Unknown: mammalian sequence
ETVAP

SEQ ID NO: 207617 - protein, 6 aa, Unknown
  Description of Unknown: mammalian sequence
QGLTSF

SEQ ID NO: 207618 - protein, 7 aa, Unknown
  Description of Unknown: mammalian sequence
VSKPKME

SEQ ID NO: 207619 - protein, 5 aa, Unknown
  Description of Unknown: mammalian sequence
TVAAP

SEQ ID NO: 207620 - protein, 26 aa, Unknown
  Description of Unknown: mammalian sequence
GGNPPGGNRGTTTTRRPATTTGSSPG

SEQ ID NO: 207621 - protein, 7 aa, Unknown
  Description of Unknown: mammalian sequence
CKPCICT

SEQ ID NO: 207622 - protein, 6 aa, Unknown
  Description of Unknown: mammalian sequence
VPSEVS

SEQ ID NO: 207623 - protein, 10 aa, Unknown
  Description of Unknown: mammalian sequence
EPKSCDKTHT

SEQ ID NO: 207624 - protein, 7 aa, Unknown
  Description of Unknown: mammalian sequence
CPPCKCP

SEQ ID NO: 207625 - protein, 9 aa, Unknown
  Description of Unknown: mammalian sequence
EPRGPTIKP

SEQ ID NO: 207626 - protein, 5 aa, Unknown
  Description of Unknown: mammalian sequence
ATENE

SEQ ID NO: 207627 - protein, 6 aa, Unknown
  Description of Unknown: mammalian sequence
AKSVGI

SEQ ID NO: 207628 - protein, 7 aa, Unknown
  Description of Unknown: mammalian sequence
ATWTGDS

SEQ ID NO: 207629 - protein, 10 aa, Unknown
  Description of Unknown: mammalian sequence
ATITNANWDD

SEQ ID NO: 207630 - protein, 11 aa, Unknown
  Description of Unknown: mammalian sequence
NGKDFSEPLPE

SEQ ID NO: 207631 - protein, 6 aa, Unknown
  Description of Unknown: mammalian sequence
KQPLRR

SEQ ID NO: 207632 - protein, 8 aa, Unknown
  Description of Unknown: mammalian sequence
LSPYTESS

SEQ ID NO: 207633 - protein, 4 aa, Unknown
  Description of Unknown: mammalian sequence
VDSE

SEQ ID NO: 207634 - protein, 5 aa, Unknown
  Description of Unknown: mammalian sequence
FVTGP

SEQ ID NO: 207635 - protein, 7 aa, Unknown
  Description of Unknown: mammalian sequence
IKGDAYY

SEQ ID NO: 207636 - protein, 8 aa, Unknown
  Description of Unknown: mammalian sequence
TKSGVVHF

SEQ ID NO: 207637 - protein, 9 aa, Unknown
  Description of Unknown: mammalian sequence
VVLGEEVSF

SEQ ID NO: 207638 - protein, 12 aa, Unknown
  Description of Unknown: mammalian sequence
IVPNDAAKPYNM

SEQ ID NO: 207639 - protein, 26 aa, Unknown
  Description of Unknown: mammalian sequence
YLPSNNMEEPPYIDTGDPADRDATGV

SEQ ID NO: 207640 - protein, 4 aa, Unknown
  Description of Unknown: mammalian sequence
GALP

SEQ ID NO: 207641 - protein, 8 aa, Unknown
  Description of Unknown: mammalian sequence
FGVDWLKG

SEQ ID NO: 207642 - protein, 4 aa, Unknown
  Description of Unknown: mammalian sequence
ILPQ

SEQ ID NO: 207643 - protein, 7 aa, Unknown
  Description of Unknown: mammalian sequence
EAPLDNS

SEQ ID NO: 207644 - protein, 14 aa, Unknown
  Description of Unknown: mammalian sequence
AAERVPLANPFAGE

SEQ ID NO: 207645 - protein, 4 aa, Unknown
  Description of Unknown: mammalian sequence
EGVL

SEQ ID NO: 207646 - protein, 6 aa, Unknown
  Description of Unknown: mammalian sequence
LVKIEP

SEQ ID NO: 207647 - protein, 6 aa, Unknown
  Description of Unknown: mammalian sequence
RSLIGD

SEQ ID NO: 207648 - protein, 7 aa, Unknown
  Description of Unknown: mammalian sequence
DASAVHP

SEQ ID NO: 207649 - protein, 7 aa, Unknown
  Description of Unknown: mammalian sequence
EFPELDV

SEQ ID NO: 207650 - protein, 7 aa, Unknown
  Description of Unknown: mammalian sequence
FSDYFEH

SEQ ID NO: 207651 - protein, 7 aa, Unknown
  Description of Unknown: mammalian sequence
KVSRLGE

SEQ ID NO: 207652 - protein, 7 aa, Unknown
  Description of Unknown: mammalian sequence
NGAFRTR

SEQ ID NO: 207653 - protein, 7 aa, Unknown
  Description of Unknown: mammalian sequence
PLKSAPS

SEQ ID NO: 207654 - protein, 8 aa, Unknown
  Description of Unknown: mammalian sequence
ARISGLNS

SEQ ID NO: 207655 - protein, 10 aa, Unknown
  Description of Unknown: mammalian sequence
QRIAADTERD

SEQ ID NO: 207656 - protein, 11 aa, Unknown
  Description of Unknown: mammalian sequence
ERFGLSNQGRA

SEQ ID NO: 207657 - protein, 11 aa, Unknown
  Description of Unknown: mammalian sequence
LLAAPAGPRAT

SEQ ID NO: 207658 - protein, 12 aa, Unknown
  Description of Unknown: mammalian sequence
KVGEEAPGTLHP

SEQ ID NO: 207659 - protein, 12 aa, Unknown
  Description of Unknown: mammalian sequence
NAVGVDVNTASA

SEQ ID NO: 207660 - protein, 13 aa, Unknown
  Description of Unknown: mammalian sequence
AAGFLRVMNGDNP

SEQ ID NO: 207661 - protein, 13 aa, Unknown
  Description of Unknown: mammalian sequence
GVESLKDLKPGMV

SEQ ID NO: 207662 - protein, 13 aa, Unknown
  Description of Unknown: mammalian sequence
SIGVGQYQHDVSQ

SEQ ID NO: 207663 - protein, 17 aa, Unknown
  Description of Unknown: mammalian sequence
LDKPGRDPRPEFKTAEF

SEQ ID NO: 207664 - protein, 23 aa, Unknown
  Description of Unknown: mammalian sequence
LKRLDPKKFTDETFGLPTVTDIL

SEQ ID NO: 207665 - protein, 4 aa, Unknown
  Description of Unknown: mammalian sequence
LEGE

SEQ ID NO: 207666 - protein, 5 aa, Unknown
  Description of Unknown: mammalian sequence
RLGFK

SEQ ID NO: 207667 - protein, 9 aa, Unknown
  Description of Unknown: mammalian sequence
RGRPFEPPV

SEQ ID NO: 207668 - protein, 15 aa, Unknown
  Description of Unknown: mammalian sequence
RGEVEETLKEDLPNV

SEQ ID NO: 207669 - protein, 4 aa, Unknown
  Description of Unknown: mammalian sequence
LEYE

SEQ ID NO: 207670 - protein, 9 aa, Unknown
  Description of Unknown: mammalian sequence
SYGLPPLNA

SEQ ID NO: 207671 - protein, 5 aa, Unknown
  Description of Unknown: mammalian sequence
ILHDE

SEQ ID NO: 207672 - protein, 13 aa, Unknown
  Description of Unknown: mammalian sequence
KGWGGLPIGTEGR

SEQ ID NO: 207673 - protein, 4 aa, Unknown
  Description of Unknown: mammalian sequence
PQSP

SEQ ID NO: 207674 - protein, 6 aa, Unknown
  Description of Unknown: mammalian sequence
DGFEAL

SEQ ID NO: 207675 - protein, 6 aa, Unknown
  Description of Unknown: mammalian sequence
EQNPWK

SEQ ID NO: 207676 - protein, 6 aa, Unknown
  Description of Unknown: mammalian sequence
SEHWQR

SEQ ID NO: 207677 - protein, 9 aa, Unknown
  Description of Unknown: mammalian sequence
LDPQACPTV

SEQ ID NO: 207678 - protein, 5 aa, Unknown
  Description of Unknown: mammalian sequence
KTPLT

SEQ ID NO: 207679 - protein, 6 aa, Unknown
  Description of Unknown: mammalian sequence
LRQLTT

SEQ ID NO: 207680 - protein, 4 aa, Unknown
  Description of Unknown: mammalian sequence
QNDI

SEQ ID NO: 207681 - protein, 7 aa, Unknown
  Description of Unknown: mammalian sequence
INARAPV

SEQ ID NO: 207682 - protein, 9 aa, Unknown
  Description of Unknown: mammalian sequence
TVTHGDIDL

SEQ ID NO: 207683 - protein, 10 aa, Unknown
  Description of Unknown: mammalian sequence
TKTDVAGEAE

SEQ ID NO: 207684 - protein, 24 aa, Unknown
  Description of Unknown: mammalian sequence
LFNTNGFMLEENVVSTKPRFHFIA

SEQ ID NO: 207685 - protein, 7 aa, Unknown
  Description of Unknown: mammalian sequence
ASLDQPF

SEQ ID NO: 207686 - protein, 9 aa, Unknown
  Description of Unknown: mammalian sequence
VKPGRQYQE

SEQ ID NO: 207687 - protein, 4 aa, Unknown
  Description of Unknown: mammalian sequence
DGFE

SEQ ID NO: 207688 - protein, 5 aa, Unknown
  Description of Unknown: mammalian sequence
LRRFN

SEQ ID NO: 207689 - protein, 6 aa, Unknown
  Description of Unknown: mammalian sequence
KRTGET

SEQ ID NO: 207690 - protein, 16 aa, Unknown
  Description of Unknown: mammalian sequence
VEGEQSIPMVSRLGMK

SEQ ID NO: 207691 - protein, 22 aa, Unknown
  Description of Unknown: mammalian sequence
AEGHITTNHVAATRAAKSKVRR

SEQ ID NO: 207692 - protein, 8 aa, Unknown
  Description of Unknown: mammalian sequence
VDKSDEPL

SEQ ID NO: 207693 - protein, 7 aa, Unknown
  Description of Unknown: mammalian sequence
IVSPANE

SEQ ID NO: 207694 - protein, 11 aa, Unknown
  Description of Unknown: mammalian sequence
VENEPNLCYNA

SEQ ID NO: 207695 - protein, 13 aa, Unknown
  Description of Unknown: mammalian sequence
FITLEENKPTRPV

SEQ ID NO: 207696 - protein, 4 aa, Unknown
  Description of Unknown: mammalian sequence
EDGI

SEQ ID NO: 207697 - protein, 4 aa, Unknown
  Description of Unknown: mammalian sequence
HKLK

SEQ ID NO: 207698 - protein, 4 aa, Unknown
  Description of Unknown: mammalian sequence
KGGE

SEQ ID NO: 207699 - protein, 4 aa, Unknown
  Description of Unknown: mammalian sequence
SHSL

SEQ ID NO: 207700 - protein, 6 aa, Unknown
  Description of Unknown: mammalian sequence
WSTDIL

SEQ ID NO: 207701 - protein, 9 aa, Unknown
  Description of Unknown: mammalian sequence
DIIKPDPPK

SEQ ID NO: 207702 - protein, 13 aa, Unknown
  Description of Unknown: mammalian sequence
KDQKEPKNKTFLR

SEQ ID NO: 207703 - protein, 7 aa, Unknown
  Description of Unknown: mammalian sequence
WDNQCQC

SEQ ID NO: 207704 - protein, 42 aa, Unknown
  Description of Unknown: mammalian sequence
SSATRSTTKQVTPQPEEQKERKTTEMQSPMQPVDQASLPGHC

SEQ ID NO: 207705 - protein, 5 aa, Unknown
  Description of Unknown: mammalian sequence
LNKPI

SEQ ID NO: 207706 - protein, 5 aa, Unknown
  Description of Unknown: mammalian sequence
NHQSN

SEQ ID NO: 207707 - protein, 5 aa, Unknown
  Description of Unknown: mammalian sequence
NSIDQ

SEQ ID NO: 207708 - protein, 7 aa, Unknown
  Description of Unknown: mammalian sequence
YLPNVTK

SEQ ID NO: 207709 - protein, 9 aa, Unknown
  Description of Unknown: mammalian sequence
LANLKNLGW

SEQ ID NO: 207710 - protein, 9 aa, Unknown
  Description of Unknown: mammalian sequence
LKDLKKLKS

SEQ ID NO: 207711 - protein, 10 aa, Unknown
  Description of Unknown: mammalian sequence
FLDENKVKDL

SEQ ID NO: 207712 - protein, 10 aa, Unknown
  Description of Unknown: mammalian sequence
NLKKKSVTDA

SEQ ID NO: 207713 - protein, 11 aa, Unknown
  Description of Unknown: mammalian sequence
FLNGNKLTDIK

SEQ ID NO: 207714 - protein, 11 aa, Unknown
  Description of Unknown: mammalian sequence
PNTVKNTDGSL

SEQ ID NO: 207715 - protein, 11 aa, Unknown
  Description of Unknown: mammalian sequence
SLEHNGISDIN

SEQ ID NO: 207716 - protein, 13 aa, Unknown
  Description of Unknown: mammalian sequence
IANNSDIKSVQGI

SEQ ID NO: 207717 - protein, 5 aa, Unknown
  Description of Unknown: mammalian sequence
FTTLT

SEQ ID NO: 207718 - protein, 5 aa, Unknown
  Description of Unknown: mammalian sequence
KAPEV

SEQ ID NO: 207719 - protein, 9 aa, Unknown
  Description of Unknown: mammalian sequence
VSDVAVDVV

SEQ ID NO: 207720 - protein, 6 aa, Unknown
  Description of Unknown: mammalian sequence
INTSYF

SEQ ID NO: 207721 - protein, 22 aa, Unknown
  Description of Unknown: mammalian sequence
SGIISLEDLPDYTRSDEPLNSI

SEQ ID NO: 207722 - protein, 4 aa, Unknown
  Description of Unknown: mammalian sequence
VNGQ

SEQ ID NO: 207723 - protein, 5 aa, Unknown
  Description of Unknown: mammalian sequence
FKNAT

SEQ ID NO: 207724 - protein, 5 aa, Unknown
  Description of Unknown: mammalian sequence
FYPNR

SEQ ID NO: 207725 - protein, 5 aa, Unknown
  Description of Unknown: mammalian sequence
MDNDV

SEQ ID NO: 207726 - protein, 6 aa, Unknown
  Description of Unknown: mammalian sequence
FPVPTL

SEQ ID NO: 207727 - protein, 6 aa, Unknown
  Description of Unknown: mammalian sequence
VNDQGQ

SEQ ID NO: 207728 - protein, 7 aa, Unknown
  Description of Unknown: mammalian sequence
SSFTPNV

SEQ ID NO: 207729 - protein, 7 aa, Unknown
  Description of Unknown: mammalian sequence
VKGTIAA

SEQ ID NO: 207730 - protein, 8 aa, Unknown
  Description of Unknown: mammalian sequence
SKKFPSYS

SEQ ID NO: 207731 - protein, 9 aa, Unknown
  Description of Unknown: mammalian sequence
ITYQTYSEV

SEQ ID NO: 207732 - protein, 10 aa, Unknown
  Description of Unknown: mammalian sequence
FATDKGFPKT

SEQ ID NO: 207733 - protein, 12 aa, Unknown
  Description of Unknown: mammalian sequence
TADPIPDAGRSS

SEQ ID NO: 207734 - protein, 4 aa, Unknown
  Description of Unknown: mammalian sequence
EKCF

SEQ ID NO: 207735 - protein, 4 aa, Unknown
  Description of Unknown: mammalian sequence
KNGK

SEQ ID NO: 207736 - protein, 5 aa, Unknown
  Description of Unknown: mammalian sequence
EKSHM

SEQ ID NO: 207737 - protein, 5 aa, Unknown
  Description of Unknown: mammalian sequence
NTNSD

SEQ ID NO: 207738 - protein, 6 aa, Unknown
  Description of Unknown: mammalian sequence
NAPEKH

SEQ ID NO: 207739 - protein, 7 aa, Unknown
  Description of Unknown: mammalian sequence
ACPVAAL

SEQ ID NO: 207740 - protein, 7 aa, Unknown
  Description of Unknown: mammalian sequence
DERSKSL

SEQ ID NO: 207741 - protein, 7 aa, Unknown
  Description of Unknown: mammalian sequence
KCLLCGR

SEQ ID NO: 207742 - protein, 7 aa, Unknown
  Description of Unknown: mammalian sequence
TETYAMK

SEQ ID NO: 207743 - protein, 9 aa, Unknown
  Description of Unknown: mammalian sequence
DTNCLLCGQ

SEQ ID NO: 207744 - protein, 10 aa, Unknown
  Description of Unknown: mammalian sequence
NGGGQPHVNP

SEQ ID NO: 207745 - protein, 14 aa, Unknown
  Description of Unknown: mammalian sequence
YKARASKPFLPKDK

SEQ ID NO: 207746 - protein, 18 aa, Unknown
  Description of Unknown: mammalian sequence
LDIHEFKCGPCNRRENCE

SEQ ID NO: 207747 - protein, 6 aa, Unknown
  Description of Unknown: mammalian sequence
VVGGEL

SEQ ID NO: 207748 - protein, 5 aa, Unknown
  Description of Unknown: mammalian sequence
HNGFF

SEQ ID NO: 207749 - protein, 11 aa, Unknown
  Description of Unknown: mammalian sequence
VKGKEGDEEEE

SEQ ID NO: 207750 - protein, 4 aa, Unknown
  Description of Unknown: mammalian sequence
KLIV

SEQ ID NO: 207751 - protein, 6 aa, Unknown
  Description of Unknown: mammalian sequence
TIGNRA

SEQ ID NO: 207752 - protein, 13 aa, Unknown
  Description of Unknown: mammalian sequence
VPPSKPTVNIPSS

SEQ ID NO: 207753 - protein, 5 aa, Unknown
  Description of Unknown: mammalian sequence
FFSIL

SEQ ID NO: 207754 - protein, 6 aa, Unknown
  Description of Unknown: mammalian sequence
TTGEWK

SEQ ID NO: 207755 - protein, 7 aa, Unknown
  Description of Unknown: mammalian sequence
MSTEEAE

SEQ ID NO: 207756 - protein, 8 aa, Unknown
  Description of Unknown: mammalian sequence
ASQVESDW

SEQ ID NO: 207757 - protein, 7 aa, Unknown
  Description of Unknown: mammalian sequence
KLHLSNC

SEQ ID NO: 207758 - protein, 4 aa, Unknown
  Description of Unknown: mammalian sequence
DANF

SEQ ID NO: 207759 - protein, 7 aa, Unknown
  Description of Unknown: mammalian sequence
VGLEKNA

SEQ ID NO: 207760 - protein, 8 aa, Unknown
  Description of Unknown: mammalian sequence
TNSTEETL

SEQ ID NO: 207761 - protein, 9 aa, Unknown
  Description of Unknown: mammalian sequence
KTWENVNAQ

SEQ ID NO: 207762 - protein, 9 aa, Unknown
  Description of Unknown: mammalian sequence
YLPTLYVSQ

SEQ ID NO: 207763 - protein, 11 aa, Unknown
  Description of Unknown: mammalian sequence
SHRYGFGKIDA

SEQ ID NO: 207764 - protein, 12 aa, Unknown
  Description of Unknown: mammalian sequence
GDWRDSAMGKKY

SEQ ID NO: 207765 - protein, 4 aa, Unknown
  Description of Unknown: mammalian sequence
KGTL

SEQ ID NO: 207766 - protein, 7 aa, Unknown
  Description of Unknown: mammalian sequence
KLNKDIV

SEQ ID NO: 207767 - protein, 8 aa, Unknown
  Description of Unknown: mammalian sequence
ETRKRALS

SEQ ID NO: 207768 - protein, 33 aa, Unknown
  Description of Unknown: mammalian sequence
VYPPDYNPEGKVTKRKHDNEGSGSKRPKVEYSE

SEQ ID NO: 207769 - protein, 8 aa, Unknown
  Description of Unknown: mammalian sequence
IERHSIHW

SEQ ID NO: 207770 - protein, 9 aa, Unknown
  Description of Unknown: mammalian sequence
DLTGTPLFV

SEQ ID NO: 207771 - protein, 10 aa, Unknown
  Description of Unknown: mammalian sequence
NGPASLPYDI

SEQ ID NO: 207772 - protein, 14 aa, Unknown
  Description of Unknown: mammalian sequence
VNGSDINVDWGKPI

SEQ ID NO: 207773 - protein, 44 aa, Unknown
  Description of Unknown: mammalian sequence
YAGAPGGLPTDEGTPPVDHQCLDTLDVRPVVPRSVPVNSFVKRP

SEQ ID NO: 207774 - protein, 6 aa, Unknown
  Description of Unknown: mammalian sequence
QFGRKG

SEQ ID NO: 207775 - protein, 9 aa, Unknown
  Description of Unknown: mammalian sequence
IASGAIGGL

SEQ ID NO: 207776 - protein, 4 aa, Unknown
  Description of Unknown: mammalian sequence
SGNP

SEQ ID NO: 207777 - protein, 6 aa, Unknown
  Description of Unknown: mammalian sequence
VTGISP

SEQ ID NO: 207778 - protein, 6 aa, Unknown
  Description of Unknown: mammalian sequence
IKRADA

SEQ ID NO: 207779 - protein, 7 aa, Unknown
  Description of Unknown: mammalian sequence
VQPKLTA

SEQ ID NO: 207780 - protein, 14 aa, Unknown
  Description of Unknown: mammalian sequence
TGVMKNDTNENLKK

SEQ ID NO: 207781 - protein, 24 aa, Unknown
  Description of Unknown: mammalian sequence
FLPRVGVGTSFGLPQTRRISLASP

SEQ ID NO: 207782 - protein, 4 aa, Unknown
  Description of Unknown: mammalian sequence
ASNM

SEQ ID NO: 207783 - protein, 6 aa, Unknown
  Description of Unknown: mammalian sequence
ESKPSV

SEQ ID NO: 207784 - protein, 7 aa, Unknown
  Description of Unknown: mammalian sequence
IKMLGSK

SEQ ID NO: 207785 - protein, 7 aa, Unknown
  Description of Unknown: mammalian sequence
LRREPNL

SEQ ID NO: 207786 - protein, 7 aa, Unknown
  Description of Unknown: mammalian sequence
LSRSSNP

SEQ ID NO: 207787 - protein, 8 aa, Unknown
  Description of Unknown: mammalian sequence
RLGCRYSK

SEQ ID NO: 207788 - protein, 4 aa, Unknown
  Description of Unknown: mammalian sequence
ETPA

SEQ ID NO: 207789 - protein, 8 aa, Unknown
  Description of Unknown: mammalian sequence
FANHTYVP

SEQ ID NO: 207790 - protein, 5 aa, Unknown
  Description of Unknown: mammalian sequence
LFEWL

SEQ ID NO: 207791 - protein, 14 aa, Unknown
  Description of Unknown: mammalian sequence
HELGGKNASGGYGG

SEQ ID NO: 207792 - protein, 5 aa, Unknown
  Description of Unknown: mammalian sequence
RGDVG

SEQ ID NO: 207793 - protein, 4 aa, Unknown
  Description of Unknown: mammalian sequence
DYTR

SEQ ID NO: 207794 - protein, 8 aa, Unknown
  Description of Unknown: mammalian sequence
QTQAVSQQ

SEQ ID NO: 207795 - protein, 8 aa, Unknown
  Description of Unknown: mammalian sequence
YTDHQMLV

SEQ ID NO: 207796 - protein, 4 aa, Unknown
  Description of Unknown: mammalian sequence
LNNR

SEQ ID NO: 207797 - protein, 12 aa, Unknown
  Description of Unknown: mammalian sequence
TCRKTNKLSPYD

SEQ ID NO: 207798 - protein, 5 aa, Unknown
  Description of Unknown: mammalian sequence
VVNNV

SEQ ID NO: 207799 - protein, 7 aa, Unknown
  Description of Unknown: mammalian sequence
VQARASS

SEQ ID NO: 207800 - protein, 8 aa, Unknown
  Description of Unknown: mammalian sequence
TYIPRKEV

SEQ ID NO: 207801 - protein, 10 aa, Unknown
  Description of Unknown: mammalian sequence
IQATIIRQNQ

SEQ ID NO: 207802 - protein, 4 aa, Unknown
  Description of Unknown: mammalian sequence
KGDD

SEQ ID NO: 207803 - protein, 4 aa, Unknown
  Description of Unknown: mammalian sequence
SDVV

SEQ ID NO: 207804 - protein, 6 aa, Unknown
  Description of Unknown: mammalian sequence
VAQSSY

SEQ ID NO: 207805 - protein, 8 aa, Unknown
  Description of Unknown: mammalian sequence
TSRDYDTQ

SEQ ID NO: 207806 - protein, 11 aa, Unknown
  Description of Unknown: mammalian sequence
YAPFLPKTWTS

SEQ ID NO: 207807 - protein, 5 aa, Unknown
  Description of Unknown: mammalian sequence
AGVNL

SEQ ID NO: 207808 - protein, 11 aa, Unknown
  Description of Unknown: mammalian sequence
TLLLKSPTTHP

SEQ ID NO: 207809 - protein, 5 aa, Unknown
  Description of Unknown: mammalian sequence
VESAM

SEQ ID NO: 207810 - protein, 6 aa, Unknown
  Description of Unknown: mammalian sequence
GPLWSN

SEQ ID NO: 207811 - protein, 9 aa, Unknown
  Description of Unknown: mammalian sequence
QVENTGIHE

SEQ ID NO: 207812 - protein, 8 aa, Unknown
  Description of Unknown: mammalian sequence
SCDNLPHN

SEQ ID NO: 207813 - protein, 16 aa, Unknown
  Description of Unknown: mammalian sequence
ICDRNHTWLPVSDDAC

SEQ ID NO: 207814 - protein, 4 aa, Unknown
  Description of Unknown: mammalian sequence
YYPA

SEQ ID NO: 207815 - protein, 5 aa, Unknown
  Description of Unknown: mammalian sequence
SGQPL

SEQ ID NO: 207816 - protein, 5 aa, Unknown
  Description of Unknown: mammalian sequence
VYSGK

SEQ ID NO: 207817 - protein, 7 aa, Unknown
  Description of Unknown: mammalian sequence
VNDQGKE

SEQ ID NO: 207818 - protein, 11 aa, Unknown
  Description of Unknown: mammalian sequence
FGNKYWLMLNE

SEQ ID NO: 207819 - protein, 19 aa, Unknown
  Description of Unknown: mammalian sequence
QSFAPVKGASAVPLVGRAS

SEQ ID NO: 207820 - protein, 4 aa, Unknown
  Description of Unknown: mammalian sequence
PVSE

SEQ ID NO: 207821 - protein, 5 aa, Unknown
  Description of Unknown: mammalian sequence
AGKLV

SEQ ID NO: 207822 - protein, 7 aa, Unknown
  Description of Unknown: mammalian sequence
LEKDGSN

SEQ ID NO: 207823 - protein, 14 aa, Unknown
  Description of Unknown: mammalian sequence
NNDPSWNPGPTWDP

SEQ ID NO: 207824 - protein, 4 aa, Unknown
  Description of Unknown: mammalian sequence
GVPF

SEQ ID NO: 207825 - protein, 4 aa, Unknown
  Description of Unknown: mammalian sequence
ICQS

SEQ ID NO: 207826 - protein, 6 aa, Unknown
  Description of Unknown: mammalian sequence
VNYEDP

SEQ ID NO: 207827 - protein, 8 aa, Unknown
  Description of Unknown: mammalian sequence
RARGENEP

SEQ ID NO: 207828 - protein, 6 aa, Unknown
  Description of Unknown: mammalian sequence
LAGTGP

SEQ ID NO: 207829 - protein, 10 aa, Unknown
  Description of Unknown: mammalian sequence
AAGGSVKGKK

SEQ ID NO: 207830 - protein, 8 aa, Unknown
  Description of Unknown: mammalian sequence
LMTPEYVA

SEQ ID NO: 207831 - protein, 17 aa, Unknown
  Description of Unknown: mammalian sequence
GFESVLEAVTALAFYVP

SEQ ID NO: 207832 - protein, 18 aa, Unknown
  Description of Unknown: mammalian sequence
HKLGAVDVPDLVYSEAGP

SEQ ID NO: 207833 - protein, 35 aa, Unknown
  Description of Unknown: mammalian sequence
QHPPKDSSGQRVAVSPTSQRLQLLEPFDKWDGKDL

SEQ ID NO: 207834 - protein, 41 aa, Unknown
  Description of Unknown: mammalian sequence
TLKFNPETDFLTGKDGKKFKLEAPDADELPRAEFDPGQDTY

SEQ ID NO: 207835 - protein, 4 aa, Unknown
  Description of Unknown: mammalian sequence
LVLE

SEQ ID NO: 207836 - protein, 4 aa, Unknown
  Description of Unknown: mammalian sequence
SESG

SEQ ID NO: 207837 - protein, 5 aa, Unknown
  Description of Unknown: mammalian sequence
EISGM

SEQ ID NO: 207838 - protein, 5 aa, Unknown
  Description of Unknown: mammalian sequence
FAARS

SEQ ID NO: 207839 - protein, 7 aa, Unknown
  Description of Unknown: mammalian sequence
QKSGKGL

SEQ ID NO: 207840 - protein, 11 aa, Unknown
  Description of Unknown: mammalian sequence
GEVFPQKKVSA

SEQ ID NO: 207841 - protein, 13 aa, Unknown
  Description of Unknown: mammalian sequence
KHPAVRKEPGPGL

SEQ ID NO: 207842 - protein, 14 aa, Unknown
  Description of Unknown: mammalian sequence
YPHWEGEIIRFETE

SEQ ID NO: 207843 - protein, 9 aa, Unknown
  Description of Unknown: mammalian sequence
EYPALGEVF

SEQ ID NO: 207844 - protein, 7 aa, Unknown
  Description of Unknown: mammalian sequence
QDDDCTP

SEQ ID NO: 207845 - protein, 4 aa, Unknown
  Description of Unknown: mammalian sequence
HNGK

SEQ ID NO: 207846 - protein, 5 aa, Unknown
  Description of Unknown: mammalian sequence
SSVSR

SEQ ID NO: 207847 - protein, 6 aa, Unknown
  Description of Unknown: mammalian sequence
AAHPVG

SEQ ID NO: 207848 - protein, 6 aa, Unknown
  Description of Unknown: mammalian sequence
ARFDVT

SEQ ID NO: 207849 - protein, 6 aa, Unknown
  Description of Unknown: mammalian sequence
EGRDMN

SEQ ID NO: 207850 - protein, 6 aa, Unknown
  Description of Unknown: mammalian sequence
KFLRTE

SEQ ID NO: 207851 - protein, 8 aa, Unknown
  Description of Unknown: mammalian sequence
LDLFYNTP

SEQ ID NO: 207852 - protein, 8 aa, Unknown
  Description of Unknown: mammalian sequence
RTAEQQEA

SEQ ID NO: 207853 - protein, 11 aa, Unknown
  Description of Unknown: mammalian sequence
YRAVPEGGQKE

SEQ ID NO: 207854 - protein, 8 aa, Unknown
  Description of Unknown: mammalian sequence
HDPRRFGR

SEQ ID NO: 207855 - protein, 10 aa, Unknown
  Description of Unknown: mammalian sequence
RRGDYREIPL

SEQ ID NO: 207856 - protein, 11 aa, Unknown
  Description of Unknown: mammalian sequence
RHAVYGREGLP

SEQ ID NO: 207857 - protein, 23 aa, Unknown
  Description of Unknown: mammalian sequence
ELGGSTLSDQSYRQPDGLPGGFQ

SEQ ID NO: 207858 - protein, 6 aa, Unknown
  Description of Unknown: mammalian sequence
ESGKTS

SEQ ID NO: 207859 - protein, 7 aa, Unknown
  Description of Unknown: mammalian sequence
FLDIHNI

SEQ ID NO: 207860 - protein, 7 aa, Unknown
  Description of Unknown: mammalian sequence
VYPNIEE

SEQ ID NO: 207861 - protein, 9 aa, Unknown
  Description of Unknown: mammalian sequence
RQGIPNESW

SEQ ID NO: 207862 - protein, 17 aa, Unknown
  Description of Unknown: mammalian sequence
TKINERYELCDTYPALL

SEQ ID NO: 207863 - protein, 4 aa, Unknown
  Description of Unknown: mammalian sequence
NGIV

SEQ ID NO: 207864 - protein, 5 aa, Unknown
  Description of Unknown: mammalian sequence
SRRVP

SEQ ID NO: 207865 - protein, 17 aa, Unknown
  Description of Unknown: mammalian sequence
LEKEKQFEKYSELKGTV

SEQ ID NO: 207866 - protein, 12 aa, Unknown
  Description of Unknown: mammalian sequence
KDSPKGVGRPTK

SEQ ID NO: 207867 - protein, 4 aa, Unknown
  Description of Unknown: mammalian sequence
ILIP

SEQ ID NO: 207868 - protein, 4 aa, Unknown
  Description of Unknown: mammalian sequence
LAPA

SEQ ID NO: 207869 - protein, 5 aa, Unknown
  Description of Unknown: mammalian sequence
CSGEY

SEQ ID NO: 207870 - protein, 5 aa, Unknown
  Description of Unknown: mammalian sequence
STPHP

SEQ ID NO: 207871 - protein, 5 aa, Unknown
  Description of Unknown: mammalian sequence
WGCDK

SEQ ID NO: 207872 - protein, 6 aa, Unknown
  Description of Unknown: mammalian sequence
YFAMDE

SEQ ID NO: 207873 - protein, 9 aa, Unknown
  Description of Unknown: mammalian sequence
RAETIDDIR

SEQ ID NO: 207874 - protein, 6 aa, Unknown
  Description of Unknown: mammalian sequence
NDDIQG

SEQ ID NO: 207875 - protein, 7 aa, Unknown
  Description of Unknown: mammalian sequence
YREKYCT

SEQ ID NO: 207876 - protein, 4 aa, Unknown
  Description of Unknown: mammalian sequence
DADL

SEQ ID NO: 207877 - protein, 4 aa, Unknown
  Description of Unknown: mammalian sequence
PNTA

SEQ ID NO: 207878 - protein, 5 aa, Unknown
  Description of Unknown: mammalian sequence
VAVGV

SEQ ID NO: 207879 - protein, 6 aa, Unknown
  Description of Unknown: mammalian sequence
VNIALA

SEQ ID NO: 207880 - protein, 17 aa, Unknown
  Description of Unknown: mammalian sequence
KNLEEPVKPFPGVQGSS

SEQ ID NO: 207881 - protein, 26 aa, Unknown
  Description of Unknown: mammalian sequence
LKGTLELHPNGLIKTDEYMRTSEPDV

SEQ ID NO: 207882 - protein, 6 aa, Unknown
  Description of Unknown: mammalian sequence
YYPQIA

SEQ ID NO: 207883 - protein, 4 aa, Unknown
  Description of Unknown: mammalian sequence
LGDA

SEQ ID NO: 207884 - protein, 7 aa, Unknown
  Description of Unknown: mammalian sequence
FKHSGGL

SEQ ID NO: 207885 - protein, 20 aa, Unknown
  Description of Unknown: mammalian sequence
FEAERKENCPACSQLPQNIQ

SEQ ID NO: 207886 - protein, 8 aa, Unknown
  Description of Unknown: mammalian sequence
YGLDTINK

SEQ ID NO: 207887 - protein, 9 aa, Unknown
  Description of Unknown: mammalian sequence
SMDNPDNEI

SEQ ID NO: 207888 - protein, 10 aa, Unknown
  Description of Unknown: mammalian sequence
QQGRYPGVSN

SEQ ID NO: 207889 - protein, 8 aa, Unknown
  Description of Unknown: mammalian sequence
TKLQNPDL

SEQ ID NO: 207890 - protein, 10 aa, Unknown
  Description of Unknown: mammalian sequence
GGRGYGSESG

SEQ ID NO: 207891 - protein, 12 aa, Unknown
  Description of Unknown: mammalian sequence
LQQHRPSPELTL

SEQ ID NO: 207892 - protein, 17 aa, Unknown
  Description of Unknown: mammalian sequence
LGGKWQPGRGPCVLQEY

SEQ ID NO: 207893 - protein, 5 aa, Unknown
  Description of Unknown: mammalian sequence
YQKLT

SEQ ID NO: 207894 - protein, 7 aa, Unknown
  Description of Unknown: mammalian sequence
FISNQTI

SEQ ID NO: 207895 - protein, 7 aa, Unknown
  Description of Unknown: mammalian sequence
SWEGNPI

SEQ ID NO: 207896 - protein, 8 aa, Unknown
  Description of Unknown: mammalian sequence
FREVVSPQ

SEQ ID NO: 207897 - protein, 9 aa, Unknown
  Description of Unknown: mammalian sequence
LADVPSSPY

SEQ ID NO: 207898 - protein, 4 aa, Unknown
  Description of Unknown: mammalian sequence
FVSA

SEQ ID NO: 207899 - protein, 4 aa, Unknown
  Description of Unknown: mammalian sequence
HKRS

SEQ ID NO: 207900 - protein, 5 aa, Unknown
  Description of Unknown: mammalian sequence
KAAPD

SEQ ID NO: 207901 - protein, 19 aa, Unknown
  Description of Unknown: mammalian sequence
PLDSPDETEDPEPNYAGEP

SEQ ID NO: 207902 - protein, 6 aa, Unknown
  Description of Unknown: mammalian sequence
EVGNEE

SEQ ID NO: 207903 - protein, 13 aa, Unknown
  Description of Unknown: mammalian sequence
ALPDEETGLELNE

SEQ ID NO: 207904 - protein, 4 aa, Unknown
  Description of Unknown: mammalian sequence
QVDA

SEQ ID NO: 207905 - protein, 5 aa, Unknown
  Description of Unknown: mammalian sequence
WRKDP

SEQ ID NO: 207906 - protein, 6 aa, Unknown
  Description of Unknown: mammalian sequence
PSHGII

SEQ ID NO: 207907 - protein, 7 aa, Unknown
  Description of Unknown: mammalian sequence
EGQGKAK

SEQ ID NO: 207908 - protein, 8 aa, Unknown
  Description of Unknown: mammalian sequence
KINLAIKT

SEQ ID NO: 207909 - protein, 8 aa, Unknown
  Description of Unknown: mammalian sequence
TEMYDTPT

SEQ ID NO: 207910 - protein, 6 aa, Unknown
  Description of Unknown: mammalian sequence
AHELPM

SEQ ID NO: 207911 - protein, 12 aa, Unknown
  Description of Unknown: mammalian sequence
EKPKGRDSKKVR

SEQ ID NO: 207912 - protein, 14 aa, Unknown
  Description of Unknown: mammalian sequence
IEGTSPEIVVNPVR

SEQ ID NO: 207913 - protein, 7 aa, Unknown
  Description of Unknown: mammalian sequence
QRTKVQI

SEQ ID NO: 207914 - protein, 26 aa, Unknown
  Description of Unknown: mammalian sequence
VDMGFDTSKLGSYQRVAEPVVPPQEM

SEQ ID NO: 207915 - protein, 5 aa, Unknown
  Description of Unknown: mammalian sequence
MNAHI

SEQ ID NO: 207916 - protein, 6 aa, Unknown
  Description of Unknown: mammalian sequence
ADDYQA

SEQ ID NO: 207917 - protein, 6 aa, Unknown
  Description of Unknown: mammalian sequence
YEGFTG

SEQ ID NO: 207918 - protein, 7 aa, Unknown
  Description of Unknown: mammalian sequence
QVDDPLK

SEQ ID NO: 207919 - protein, 11 aa, Unknown
  Description of Unknown: mammalian sequence
YKPKRFEYVTW

SEQ ID NO: 207920 - protein, 13 aa, Unknown
  Description of Unknown: mammalian sequence
ILPLWHHDDTYLF

SEQ ID NO: 207921 - protein, 22 aa, Unknown
  Description of Unknown: mammalian sequence
DMILPKKSVSKVKQTQLLTTEG

SEQ ID NO: 207922 - protein, 4 aa, Unknown
  Description of Unknown: mammalian sequence
IDNP

SEQ ID NO: 207923 - protein, 4 aa, Unknown
  Description of Unknown: mammalian sequence
GMDH

SEQ ID NO: 207924 - protein, 4 aa, Unknown
  Description of Unknown: mammalian sequence
IGDC

SEQ ID NO: 207925 - protein, 5 aa, Unknown
  Description of Unknown: mammalian sequence
EGVLH

SEQ ID NO: 207926 - protein, 5 aa, Unknown
  Description of Unknown: mammalian sequence
NQKEL

SEQ ID NO: 207927 - protein, 5 aa, Unknown
  Description of Unknown: mammalian sequence
QGNAL

SEQ ID NO: 207928 - protein, 5 aa, Unknown
  Description of Unknown: mammalian sequence
QSGYQ

SEQ ID NO: 207929 - protein, 6 aa, Unknown
  Description of Unknown: mammalian sequence
ARPDDE

SEQ ID NO: 207930 - protein, 6 aa, Unknown
  Description of Unknown: mammalian sequence
MGVSAI

SEQ ID NO: 207931 - protein, 6 aa, Unknown
  Description of Unknown: mammalian sequence
RNFQGY

SEQ ID NO: 207932 - protein, 7 aa, Unknown
  Description of Unknown: mammalian sequence
TTQGDTD

SEQ ID NO: 207933 - protein, 5 aa, Unknown
  Description of Unknown: mammalian sequence
IRDAN

SEQ ID NO: 207934 - protein, 7 aa, Unknown
  Description of Unknown: mammalian sequence
YARPSSA

SEQ ID NO: 207935 - protein, 4 aa, Unknown
  Description of Unknown: mammalian sequence
RGKF

SEQ ID NO: 207936 - protein, 4 aa, Unknown
  Description of Unknown: mammalian sequence
THAV

SEQ ID NO: 207937 - protein, 5 aa, Unknown
  Description of Unknown: mammalian sequence
ETPKI

SEQ ID NO: 207938 - protein, 5 aa, Unknown
  Description of Unknown: mammalian sequence
SDTAN

SEQ ID NO: 207939 - protein, 7 aa, Unknown
  Description of Unknown: mammalian sequence
TKQLAPT

SEQ ID NO: 207940 - protein, 10 aa, Unknown
  Description of Unknown: mammalian sequence
AGDYKNLGGE

SEQ ID NO: 207941 - protein, 19 aa, Unknown
  Description of Unknown: mammalian sequence
TYYTFNFSLEGAKMSLPGT

SEQ ID NO: 207942 - protein, 5 aa, Unknown
  Description of Unknown: mammalian sequence
YNKSS

SEQ ID NO: 207943 - protein, 8 aa, Unknown
  Description of Unknown: mammalian sequence
YGTPDYKY

SEQ ID NO: 207944 - protein, 11 aa, Unknown
  Description of Unknown: mammalian sequence
PYGKAHTLGLK

SEQ ID NO: 207945 - protein, 6 aa, Unknown
  Description of Unknown: mammalian sequence
DTEEKK

SEQ ID NO: 207946 - protein, 19 aa, Unknown
  Description of Unknown: mammalian sequence
DIPNRRRKVSKHKHANFYP

SEQ ID NO: 207947 - protein, 6 aa, Unknown
  Description of Unknown: mammalian sequence
PCSHVV

SEQ ID NO: 207948 - protein, 6 aa, Unknown
  Description of Unknown: mammalian sequence
ANENGT

SEQ ID NO: 207949 - protein, 6 aa, Unknown
  Description of Unknown: mammalian sequence
NRKNNI

SEQ ID NO: 207950 - protein, 8 aa, Unknown
  Description of Unknown: mammalian sequence
LAPEDYTG

SEQ ID NO: 207951 - protein, 4 aa, Unknown
  Description of Unknown: mammalian sequence
IGGK

SEQ ID NO: 207952 - protein, 4 aa, Unknown
  Description of Unknown: mammalian sequence
VGDD

SEQ ID NO: 207953 - protein, 6 aa, Unknown
  Description of Unknown: mammalian sequence
INTTKY

SEQ ID NO: 207954 - protein, 7 aa, Unknown
  Description of Unknown: mammalian sequence
AATVTGY

SEQ ID NO: 207955 - protein, 7 aa, Unknown
  Description of Unknown: mammalian sequence
GGADGKT

SEQ ID NO: 207956 - protein, 7 aa, Unknown
  Description of Unknown: mammalian sequence
QNKDGSI

SEQ ID NO: 207957 - protein, 7 aa, Unknown
  Description of Unknown: mammalian sequence
TDNNGKT

SEQ ID NO: 207958 - protein, 8 aa, Unknown
  Description of Unknown: mammalian sequence
AAGVTGTA

SEQ ID NO: 207959 - protein, 9 aa, Unknown
  Description of Unknown: mammalian sequence
QVGANDGET

SEQ ID NO: 207960 - protein, 11 aa, Unknown
  Description of Unknown: mammalian sequence
TADDGTSKTAL

SEQ ID NO: 207961 - protein, 21 aa, Unknown
  Description of Unknown: mammalian sequence
LKQINSQTLGLDTLNVQQKYK

SEQ ID NO: 207962 - protein, 23 aa, Unknown
  Description of Unknown: mammalian sequence
AEGHNFKAQPDLAEAAATTTENP

SEQ ID NO: 207963 - protein, 4 aa, Unknown
  Description of Unknown: mammalian sequence
AGAR

SEQ ID NO: 207964 - protein, 5 aa, Unknown
  Description of Unknown: mammalian sequence
AEALL

SEQ ID NO: 207965 - protein, 6 aa, Unknown
  Description of Unknown: mammalian sequence
AWPEEV

SEQ ID NO: 207966 - protein, 6 aa, Unknown
  Description of Unknown: mammalian sequence
NRGVEA

SEQ ID NO: 207967 - protein, 8 aa, Unknown
  Description of Unknown: mammalian sequence
EALPLPFA

SEQ ID NO: 207968 - protein, 8 aa, Unknown
  Description of Unknown: mammalian sequence
RGVDPLGQ

SEQ ID NO: 207969 - protein, 9 aa, Unknown
  Description of Unknown: mammalian sequence
LEVTPNRPD

SEQ ID NO: 207970 - protein, 9 aa, Unknown
  Description of Unknown: mammalian sequence
VEDPEGAPH

SEQ ID NO: 207971 - protein, 10 aa, Unknown
  Description of Unknown: mammalian sequence
AGSPKPPEAI

SEQ ID NO: 207972 - protein, 10 aa, Unknown
  Description of Unknown: mammalian sequence
FGLRVAPSPL

SEQ ID NO: 207973 - protein, 13 aa, Unknown
  Description of Unknown: mammalian sequence
TIPLALPAFFPAP

SEQ ID NO: 207974 - protein, 14 aa, Unknown
  Description of Unknown: mammalian sequence
LGYALVEPEAALKA

SEQ ID NO: 207975 - protein, 19 aa, Unknown
  Description of Unknown: mammalian sequence
LPLPDKPLAFQDPSRHPAA

SEQ ID NO: 207976 - protein, 5 aa, Unknown
  Description of Unknown: mammalian sequence
GLQSA

SEQ ID NO: 207977 - protein, 6 aa, Unknown
  Description of Unknown: mammalian sequence
HGELTR

SEQ ID NO: 207978 - protein, 7 aa, Unknown
  Description of Unknown: mammalian sequence
LKDKQLN

SEQ ID NO: 207979 - protein, 5 aa, Unknown
  Description of Unknown: mammalian sequence
FYPQY

SEQ ID NO: 207980 - protein, 7 aa, Unknown
  Description of Unknown: mammalian sequence
DFHYDEK

SEQ ID NO: 207981 - protein, 10 aa, Unknown
  Description of Unknown: mammalian sequence
DYLLDFSAVY

SEQ ID NO: 207982 - protein, 10 aa, Unknown
  Description of Unknown: mammalian sequence
PLDVTNRPRT

SEQ ID NO: 207983 - protein, 17 aa, Unknown
  Description of Unknown: mammalian sequence
NGEYSLKSAVKLPNVLS

SEQ ID NO: 207984 - protein, 6 aa, Unknown
  Description of Unknown: mammalian sequence
DRRAGL

SEQ ID NO: 207985 - protein, 7 aa, Unknown
  Description of Unknown: mammalian sequence
FLASMDE

SEQ ID NO: 207986 - protein, 8 aa, Unknown
  Description of Unknown: mammalian sequence
IMRETINV

SEQ ID NO: 207987 - protein, 11 aa, Unknown
  Description of Unknown: mammalian sequence
RFPNARTSYTM

SEQ ID NO: 207988 - protein, 6 aa, Unknown
  Description of Unknown: mammalian sequence
SDPAKV

SEQ ID NO: 207989 - protein, 11 aa, Unknown
  Description of Unknown: mammalian sequence
TSNGASCMPSM

SEQ ID NO: 207990 - protein, 12 aa, Unknown
  Description of Unknown: mammalian sequence
AGSAPAEPTGDV

SEQ ID NO: 207991 - protein, 7 aa, Unknown
  Description of Unknown: mammalian sequence
MRVKNDF

SEQ ID NO: 207992 - protein, 14 aa, Unknown
  Description of Unknown: mammalian sequence
YEGKDVHIKEDERY

SEQ ID NO: 207993 - protein, 15 aa, Unknown
  Description of Unknown: mammalian sequence
LGLKIIDLSAIQDEV

SEQ ID NO: 207994 - protein, 5 aa, Unknown
  Description of Unknown: mammalian sequence
LEPSR

SEQ ID NO: 207995 - protein, 6 aa, Unknown
  Description of Unknown: mammalian sequence
CSNVAA

SEQ ID NO: 207996 - protein, 8 aa, Unknown
  Description of Unknown: mammalian sequence
QKVTINPV

SEQ ID NO: 207997 - protein, 11 aa, Unknown
  Description of Unknown: mammalian sequence
ALPPGAAKQQL

SEQ ID NO: 207998 - protein, 11 aa, Unknown
  Description of Unknown: mammalian sequence
ALRRGTAGSVT

SEQ ID NO: 207999 - protein, 16 aa, Unknown
  Description of Unknown: mammalian sequence
ESFGATNTNARENTPF

SEQ ID NO: 208000 - protein, 4 aa, Unknown
  Description of Unknown: mammalian sequence
DCDY

SEQ ID NO: 208001 - protein, 4 aa, Unknown
  Description of Unknown: mammalian sequence
DWSD

SEQ ID NO: 208002 - protein, 4 aa, Unknown
  Description of Unknown: mammalian sequence
FAGQ

SEQ ID NO: 208003 - protein, 4 aa, Unknown
  Description of Unknown: mammalian sequence
HEGV

SEQ ID NO: 208004 - protein, 4 aa, Unknown
  Description of Unknown: mammalian sequence
RDGE

SEQ ID NO: 208005 - protein, 4 aa, Unknown
  Description of Unknown: mammalian sequence
SATR

SEQ ID NO: 208006 - protein, 4 aa, Unknown
  Description of Unknown: mammalian sequence
SIPA

SEQ ID NO: 208007 - protein, 4 aa, Unknown
  Description of Unknown: mammalian sequence
VYGQ

SEQ ID NO: 208008 - protein, 5 aa, Unknown
  Description of Unknown: mammalian sequence
ACGAT

SEQ ID NO: 208009 - protein, 5 aa, Unknown
  Description of Unknown: mammalian sequence
VYQAA

SEQ ID NO: 208010 - protein, 6 aa, Unknown
  Description of Unknown: mammalian sequence
EAGVDR

SEQ ID NO: 208011 - protein, 6 aa, Unknown
  Description of Unknown: mammalian sequence
SGGKTV

SEQ ID NO: 208012 - protein, 7 aa, Unknown
  Description of Unknown: mammalian sequence
VPLSEKV

SEQ ID NO: 208013 - protein, 8 aa, Unknown
  Description of Unknown: mammalian sequence
ANHPRGFA

SEQ ID NO: 208014 - protein, 9 aa, Unknown
  Description of Unknown: mammalian sequence
HDLQGERPY

SEQ ID NO: 208015 - protein, 10 aa, Unknown
  Description of Unknown: mammalian sequence
GCDGFHGISR

SEQ ID NO: 208016 - protein, 11 aa, Unknown
  Description of Unknown: mammalian sequence
ADTPPVSHELI

SEQ ID NO: 208017 - protein, 4 aa, Unknown
  Description of Unknown: mammalian sequence
GHRQ

SEQ ID NO: 208018 - protein, 4 aa, Unknown
  Description of Unknown: mammalian sequence
LTGA

SEQ ID NO: 208019 - protein, 6 aa, Unknown
  Description of Unknown: mammalian sequence
ALPSEL

SEQ ID NO: 208020 - protein, 6 aa, Unknown
  Description of Unknown: mammalian sequence
RAGGSI

SEQ ID NO: 208021 - protein, 6 aa, Unknown
  Description of Unknown: mammalian sequence
VSADNV

SEQ ID NO: 208022 - protein, 11 aa, Unknown
  Description of Unknown: mammalian sequence
HTQTDTSSPDP

SEQ ID NO: 208023 - protein, 12 aa, Unknown
  Description of Unknown: mammalian sequence
LKREKQDESCSL

SEQ ID NO: 208024 - protein, 13 aa, Unknown
  Description of Unknown: mammalian sequence
FNPLKTGVCQLDN

SEQ ID NO: 208025 - protein, 4 aa, Unknown
  Description of Unknown: mammalian sequence
ALGI

SEQ ID NO: 208026 - protein, 4 aa, Unknown
  Description of Unknown: mammalian sequence
KDGV

SEQ ID NO: 208027 - protein, 4 aa, Unknown
  Description of Unknown: mammalian sequence
NLRS

SEQ ID NO: 208028 - protein, 6 aa, Unknown
  Description of Unknown: mammalian sequence
EIPKPS

SEQ ID NO: 208029 - protein, 7 aa, Unknown
  Description of Unknown: mammalian sequence
EKMVEPQ

SEQ ID NO: 208030 - protein, 10 aa, Unknown
  Description of Unknown: mammalian sequence
KSKVYTRTPT

SEQ ID NO: 208031 - protein, 6 aa, Unknown
  Description of Unknown: mammalian sequence
ELVPKP

SEQ ID NO: 208032 - protein, 6 aa, Unknown
  Description of Unknown: mammalian sequence
FGFPGG

SEQ ID NO: 208033 - protein, 6 aa, Unknown
  Description of Unknown: mammalian sequence
LRNLDE

SEQ ID NO: 208034 - protein, 7 aa, Unknown
  Description of Unknown: mammalian sequence
FSNKKSW

SEQ ID NO: 208035 - protein, 7 aa, Unknown
  Description of Unknown: mammalian sequence
LFEKNDF

SEQ ID NO: 208036 - protein, 7 aa, Unknown
  Description of Unknown: mammalian sequence
LYPNACS

SEQ ID NO: 208037 - protein, 7 aa, Unknown
  Description of Unknown: mammalian sequence
RRAVYAN

SEQ ID NO: 208038 - protein, 7 aa, Unknown
  Description of Unknown: mammalian sequence
RSHRMPV

SEQ ID NO: 208039 - protein, 8 aa, Unknown
  Description of Unknown: mammalian sequence
EWNWPQPV

SEQ ID NO: 208040 - protein, 16 aa, Unknown
  Description of Unknown: mammalian sequence
ITPAYPSMCATHNITE

SEQ ID NO: 208041 - protein, 16 aa, Unknown
  Description of Unknown: mammalian sequence
RLDQPQVPLSLTLSDK

SEQ ID NO: 208042 - protein, 21 aa, Unknown
  Description of Unknown: mammalian sequence
ILKPIEDGPLQVRVWNPKIYA

SEQ ID NO: 208043 - protein, 16 aa, Unknown
  Description of Unknown: mammalian sequence
ISSSMTNSTAASRPPV

SEQ ID NO: 208044 - protein, 5 aa, Unknown
  Description of Unknown: mammalian sequence
ELVTV

SEQ ID NO: 208045 - protein, 11 aa, Unknown
  Description of Unknown: mammalian sequence
HDDLWQTLPDP

SEQ ID NO: 208046 - protein, 4 aa, Unknown
  Description of Unknown: mammalian sequence
QGTN

SEQ ID NO: 208047 - protein, 16 aa, Unknown
  Description of Unknown: mammalian sequence
NVYPELRVPDHQDIAF

SEQ ID NO: 208048 - protein, 6 aa, Unknown
  Description of Unknown: mammalian sequence
QLSVNQ

SEQ ID NO: 208049 - protein, 8 aa, Unknown
  Description of Unknown: mammalian sequence
DKAQFRNG

SEQ ID NO: 208050 - protein, 13 aa, Unknown
  Description of Unknown: mammalian sequence
ENPYRPVTFDYLM

SEQ ID NO: 208051 - protein, 27 aa, Unknown
  Description of Unknown: mammalian sequence
DYGNSPLHRFKKPGSKNFQNIFPPSAT

SEQ ID NO: 208052 - protein, 10 aa, Unknown
  Description of Unknown: mammalian sequence
FKPLPAQESE

SEQ ID NO: 208053 - protein, 7 aa, Unknown
  Description of Unknown: mammalian sequence
KAAGLEM

SEQ ID NO: 208054 - protein, 8 aa, Unknown
  Description of Unknown: mammalian sequence
EIPPQAII

SEQ ID NO: 208055 - protein, 27 aa, Unknown
  Description of Unknown: mammalian sequence
ESGEPSSLPRPATHWPFKTAFQHHYLV

SEQ ID NO: 208056 - protein, 8 aa, Unknown
  Description of Unknown: mammalian sequence
EVHYARPI

SEQ ID NO: 208057 - protein, 25 aa, Unknown
  Description of Unknown: mammalian sequence
WSRLKAKDWGSSSGSQGREDSVLSY

SEQ ID NO: 208058 - protein, 4 aa, Unknown
  Description of Unknown: mammalian sequence
LGTA

SEQ ID NO: 208059 - protein, 5 aa, Unknown
  Description of Unknown: mammalian sequence
LGRRF

SEQ ID NO: 208060 - protein, 6 aa, Unknown
  Description of Unknown: mammalian sequence
ANTDNT

SEQ ID NO: 208061 - protein, 6 aa, Unknown
  Description of Unknown: mammalian sequence
KRTIPA

SEQ ID NO: 208062 - protein, 7 aa, Unknown
  Description of Unknown: mammalian sequence
AIDDSNI

SEQ ID NO: 208063 - protein, 7 aa, Unknown
  Description of Unknown: mammalian sequence
PLTKTDV

SEQ ID NO: 208064 - protein, 8 aa, Unknown
  Description of Unknown: mammalian sequence
NYLVSDGI

SEQ ID NO: 208065 - protein, 9 aa, Unknown
  Description of Unknown: mammalian sequence
LLDDEGFNW

SEQ ID NO: 208066 - protein, 4 aa, Unknown
  Description of Unknown: mammalian sequence
TKAE

SEQ ID NO: 208067 - protein, 4 aa, Unknown
  Description of Unknown: mammalian sequence
TVAV

SEQ ID NO: 208068 - protein, 4 aa, Unknown
  Description of Unknown: mammalian sequence
YRTM

SEQ ID NO: 208069 - protein, 5 aa, Unknown
  Description of Unknown: mammalian sequence
ARTPL

SEQ ID NO: 208070 - protein, 5 aa, Unknown
  Description of Unknown: mammalian sequence
DRPDL

SEQ ID NO: 208071 - protein, 5 aa, Unknown
  Description of Unknown: mammalian sequence
TGTAK

SEQ ID NO: 208072 - protein, 5 aa, Unknown
  Description of Unknown: mammalian sequence
VAMQK

SEQ ID NO: 208073 - protein, 5 aa, Unknown
  Description of Unknown: mammalian sequence
YNMQV

SEQ ID NO: 208074 - protein, 6 aa, Unknown
  Description of Unknown: mammalian sequence
FRMYEK

SEQ ID NO: 208075 - protein, 6 aa, Unknown
  Description of Unknown: mammalian sequence
QAAKST

SEQ ID NO: 208076 - protein, 7 aa, Unknown
  Description of Unknown: mammalian sequence
YMTGQPV

SEQ ID NO: 208077 - protein, 8 aa, Unknown
  Description of Unknown: mammalian sequence
VVEDGQVV

SEQ ID NO: 208078 - protein, 10 aa, Unknown
  Description of Unknown: mammalian sequence
KEGLEIQNES

SEQ ID NO: 208079 - protein, 11 aa, Unknown
  Description of Unknown: mammalian sequence
AFGIDNLFDVK

SEQ ID NO: 208080 - protein, 11 aa, Unknown
  Description of Unknown: mammalian sequence
TIPTNRPVVRD

SEQ ID NO: 208081 - protein, 15 aa, Unknown
  Description of Unknown: mammalian sequence
VDSFTGRLMKGRRYS

SEQ ID NO: 208082 - protein, 24 aa, Unknown
  Description of Unknown: mammalian sequence
VRTLKAEKDYTYDIKTKAVQLTEE

SEQ ID NO: 208083 - protein, 12 aa, Unknown
  Description of Unknown: mammalian sequence
DLPPLEEGRYYY

SEQ ID NO: 208084 - protein, 18 aa, Unknown
  Description of Unknown: mammalian sequence
HGTALEHRRVVSPYGHRF

SEQ ID NO: 208085 - protein, 7 aa, Unknown
  Description of Unknown: mammalian sequence
AEANVEY

SEQ ID NO: 208086 - protein, 9 aa, Unknown
  Description of Unknown: mammalian sequence
IPLVTGPGV

SEQ ID NO: 208087 - protein, 4 aa, Unknown
  Description of Unknown: mammalian sequence
INDV

SEQ ID NO: 208088 - protein, 4 aa, Unknown
  Description of Unknown: mammalian sequence
KARL

SEQ ID NO: 208089 - protein, 5 aa, Unknown
  Description of Unknown: mammalian sequence
HPEHG

SEQ ID NO: 208090 - protein, 5 aa, Unknown
  Description of Unknown: mammalian sequence
YIGKP

SEQ ID NO: 208091 - protein, 7 aa, Unknown
  Description of Unknown: mammalian sequence
YGYRRLR

SEQ ID NO: 208092 - protein, 8 aa, Unknown
  Description of Unknown: mammalian sequence
EYLKRPLI

SEQ ID NO: 208093 - protein, 8 aa, Unknown
  Description of Unknown: mammalian sequence
FADLPRKY

SEQ ID NO: 208094 - protein, 8 aa, Unknown
  Description of Unknown: mammalian sequence
SGLQDVAH

SEQ ID NO: 208095 - protein, 13 aa, Unknown
  Description of Unknown: mammalian sequence
VGGGLSTNPMLAQ

SEQ ID NO: 208096 - protein, 15 aa, Unknown
  Description of Unknown: mammalian sequence
DDVGLQTTEACGDCP

SEQ ID NO: 208097 - protein, 16 aa, Unknown
  Description of Unknown: mammalian sequence
DGPAPEPVKHPIDHVG

SEQ ID NO: 208098 - protein, 16 aa, Unknown
  Description of Unknown: mammalian sequence
GSPLAGESLDEVLDPT

SEQ ID NO: 208099 - protein, 4 aa, Unknown
  Description of Unknown: mammalian sequence
EVRE

SEQ ID NO: 208100 - protein, 4 aa, Unknown
  Description of Unknown: mammalian sequence
HGEV

SEQ ID NO: 208101 - protein, 4 aa, Unknown
  Description of Unknown: mammalian sequence
KLPP

SEQ ID NO: 208102 - protein, 6 aa, Unknown
  Description of Unknown: mammalian sequence
FGREGN

SEQ ID NO: 208103 - protein, 6 aa, Unknown
  Description of Unknown: mammalian sequence
LGKGSS

SEQ ID NO: 208104 - protein, 6 aa, Unknown
  Description of Unknown: mammalian sequence
PFPKDV

SEQ ID NO: 208105 - protein, 6 aa, Unknown
  Description of Unknown: mammalian sequence
SEHFGE

SEQ ID NO: 208106 - protein, 6 aa, Unknown
  Description of Unknown: mammalian sequence
YTGVRR

SEQ ID NO: 208107 - protein, 7 aa, Unknown
  Description of Unknown: mammalian sequence
DTHTLDY

SEQ ID NO: 208108 - protein, 8 aa, Unknown
  Description of Unknown: mammalian sequence
ESDYEVGG

SEQ ID NO: 208109 - protein, 11 aa, Unknown
  Description of Unknown: mammalian sequence
GNLPLGAGLSS

SEQ ID NO: 208110 - protein, 13 aa, Unknown
  Description of Unknown: mammalian sequence
FSLNDLRKENSWI

SEQ ID NO: 208111 - protein, 9 aa, Unknown
  Description of Unknown: mammalian sequence
EHGLAPPDR

SEQ ID NO: 208112 - protein, 12 aa, Unknown
  Description of Unknown: mammalian sequence
AYPQTPLLPRDP

SEQ ID NO: 208113 - protein, 5 aa, Unknown
  Description of Unknown: mammalian sequence
QFATV

SEQ ID NO: 208114 - protein, 4 aa, Unknown
  Description of Unknown: mammalian sequence
LLTA

SEQ ID NO: 208115 - protein, 6 aa, Unknown
  Description of Unknown: mammalian sequence
ARHPLL

SEQ ID NO: 208116 - protein, 6 aa, Unknown
  Description of Unknown: mammalian sequence
LGGLEV

SEQ ID NO: 208117 - protein, 6 aa, Unknown
  Description of Unknown: mammalian sequence
WTEGWE

SEQ ID NO: 208118 - protein, 7 aa, Unknown
  Description of Unknown: mammalian sequence
YDEGLTS

SEQ ID NO: 208119 - protein, 8 aa, Unknown
  Description of Unknown: mammalian sequence
TLGLRSPV

SEQ ID NO: 208120 - protein, 14 aa, Unknown
  Description of Unknown: mammalian sequence
HLDLSAPKLRLREE

SEQ ID NO: 208121 - protein, 21 aa, Unknown
  Description of Unknown: mammalian sequence
YATEKEEPKPERTEVVAKLRR

SEQ ID NO: 208122 - protein, 6 aa, Unknown
  Description of Unknown: mammalian sequence
ELGVSL

SEQ ID NO: 208123 - protein, 6 aa, Unknown
  Description of Unknown: mammalian sequence
MSSKGT

SEQ ID NO: 208124 - protein, 7 aa, Unknown
  Description of Unknown: mammalian sequence
LKLGRAF

SEQ ID NO: 208125 - protein, 8 aa, Unknown
  Description of Unknown: mammalian sequence
GFNIEKFP

SEQ ID NO: 208126 - protein, 15 aa, Unknown
  Description of Unknown: mammalian sequence
TAPLPGYNTEFASGI

SEQ ID NO: 208127 - protein, 22 aa, Unknown
  Description of Unknown: mammalian sequence
CFRNEVGLPDSSKTEKVTSETV

SEQ ID NO: 208128 - protein, 4 aa, Unknown
  Description of Unknown: mammalian sequence
KSRT

SEQ ID NO: 208129 - protein, 5 aa, Unknown
  Description of Unknown: mammalian sequence
DRAGA

SEQ ID NO: 208130 - protein, 5 aa, Unknown
  Description of Unknown: mammalian sequence
FYVSA

SEQ ID NO: 208131 - protein, 5 aa, Unknown
  Description of Unknown: mammalian sequence
IATGG

SEQ ID NO: 208132 - protein, 5 aa, Unknown
  Description of Unknown: mammalian sequence
IGGGT

SEQ ID NO: 208133 - protein, 5 aa, Unknown
  Description of Unknown: mammalian sequence
LFRKI

SEQ ID NO: 208134 - protein, 5 aa, Unknown
  Description of Unknown: mammalian sequence
PRSLS

SEQ ID NO: 208135 - protein, 5 aa, Unknown
  Description of Unknown: mammalian sequence
TGKKV

SEQ ID NO: 208136 - protein, 6 aa, Unknown
  Description of Unknown: mammalian sequence
DVRGNM

SEQ ID NO: 208137 - protein, 6 aa, Unknown
  Description of Unknown: mammalian sequence
LNDGSQ

SEQ ID NO: 208138 - protein, 6 aa, Unknown
  Description of Unknown: mammalian sequence
NIENGG

SEQ ID NO: 208139 - protein, 6 aa, Unknown
  Description of Unknown: mammalian sequence
RDPGAR

SEQ ID NO: 208140 - protein, 6 aa, Unknown
  Description of Unknown: mammalian sequence
SREVKS

SEQ ID NO: 208141 - protein, 7 aa, Unknown
  Description of Unknown: mammalian sequence
RQWNGKE

SEQ ID NO: 208142 - protein, 7 aa, Unknown
  Description of Unknown: mammalian sequence
SIYFQPP

SEQ ID NO: 208143 - protein, 8 aa, Unknown
  Description of Unknown: mammalian sequence
VPQIRAPS

SEQ ID NO: 208144 - protein, 8 aa, Unknown
  Description of Unknown: mammalian sequence
WFSDDPNV

SEQ ID NO: 208145 - protein, 11 aa, Unknown
  Description of Unknown: mammalian sequence
SEDPELPYMRP

SEQ ID NO: 208146 - protein, 8 aa, Unknown
  Description of Unknown: mammalian sequence
AFDGPFDE

SEQ ID NO: 208147 - protein, 6 aa, Unknown
  Description of Unknown: mammalian sequence
HGDDRG

SEQ ID NO: 208148 - protein, 5 aa, Unknown
  Description of Unknown: mammalian sequence
LRPSP

SEQ ID NO: 208149 - protein, 4 aa, Unknown
  Description of Unknown: mammalian sequence
LNVA

SEQ ID NO: 208150 - protein, 6 aa, Unknown
  Description of Unknown: mammalian sequence
LSTSQK

SEQ ID NO: 208151 - protein, 21 aa, Unknown
  Description of Unknown: mammalian sequence
GAADIGLGYPNGNQGWGRVTL

SEQ ID NO: 208152 - protein, 4 aa, Unknown
  Description of Unknown: mammalian sequence
YIGI

SEQ ID NO: 208153 - protein, 7 aa, Unknown
  Description of Unknown: mammalian sequence
DGRVIRG

SEQ ID NO: 208154 - protein, 17 aa, Unknown
  Description of Unknown: mammalian sequence
TLSFDKSNDGETPEGIG

SEQ ID NO: 208155 - protein, 18 aa, Unknown
  Description of Unknown: mammalian sequence
EIAPLHAQGGGIDQLQGI

SEQ ID NO: 208156 - protein, 4 aa, Unknown
  Description of Unknown: mammalian sequence
ANNG

SEQ ID NO: 208157 - protein, 4 aa, Unknown
  Description of Unknown: mammalian sequence
ESNL

SEQ ID NO: 208158 - protein, 4 aa, Unknown
  Description of Unknown: mammalian sequence
KISA

SEQ ID NO: 208159 - protein, 4 aa, Unknown
  Description of Unknown: mammalian sequence
MDSA

SEQ ID NO: 208160 - protein, 4 aa, Unknown
  Description of Unknown: mammalian sequence
MMTP

SEQ ID NO: 208161 - protein, 4 aa, Unknown
  Description of Unknown: mammalian sequence
VGGI

SEQ ID NO: 208162 - protein, 5 aa, Unknown
  Description of Unknown: mammalian sequence
YTQRL

SEQ ID NO: 208163 - protein, 6 aa, Unknown
  Description of Unknown: mammalian sequence
AEKGKA

SEQ ID NO: 208164 - protein, 6 aa, Unknown
  Description of Unknown: mammalian sequence
MIRVPV

SEQ ID NO: 208165 - protein, 7 aa, Unknown
  Description of Unknown: mammalian sequence
SYTATED

SEQ ID NO: 208166 - protein, 8 aa, Unknown
  Description of Unknown: mammalian sequence
ETINPAHP

SEQ ID NO: 208167 - protein, 8 aa, Unknown
  Description of Unknown: mammalian sequence
SKFSGGNL

SEQ ID NO: 208168 - protein, 8 aa, Unknown
  Description of Unknown: mammalian sequence
TAYFVDAP

SEQ ID NO: 208169 - protein, 9 aa, Unknown
  Description of Unknown: mammalian sequence
ISPKEPHNK

SEQ ID NO: 208170 - protein, 9 aa, Unknown
  Description of Unknown: mammalian sequence
LSDKPGNPV

SEQ ID NO: 208171 - protein, 9 aa, Unknown
  Description of Unknown: mammalian sequence
RYPSITRDM

SEQ ID NO: 208172 - protein, 10 aa, Unknown
  Description of Unknown: mammalian sequence
MLSQVPYFSR

SEQ ID NO: 208173 - protein, 11 aa, Unknown
  Description of Unknown: mammalian sequence
APSRYFASEPK

SEQ ID NO: 208174 - protein, 14 aa, Unknown
  Description of Unknown: mammalian sequence
HTLDAVNIADRYDA

SEQ ID NO: 208175 - protein, 31 aa, Unknown
  Description of Unknown: mammalian sequence
ADIALSLPELNPYIPDDFSLIKSEKKYDHPE

SEQ ID NO: 208176 - protein, 7 aa, Unknown
  Description of Unknown: mammalian sequence
DVQPMQY

SEQ ID NO: 208177 - protein, 11 aa, Unknown
  Description of Unknown: mammalian sequence
HMSPSWTLLKL

SEQ ID NO: 208178 - protein, 8 aa, Unknown
  Description of Unknown: mammalian sequence
LEMVSKPM

SEQ ID NO: 208179 - protein, 51 aa, Unknown
  Description of Unknown: mammalian sequence
YGPKGKGKGMGAGTLSTDKGESLGIKYEEGQSHRPTNPNASRMAQKVGGSD

SEQ ID NO: 208180 - protein, 5 aa, Unknown
  Description of Unknown: mammalian sequence
VGQSL

SEQ ID NO: 208181 - protein, 6 aa, Unknown
  Description of Unknown: mammalian sequence
VSRSST

SEQ ID NO: 208182 - protein, 12 aa, Unknown
  Description of Unknown: mammalian sequence
ERNDVAPNKPDE

SEQ ID NO: 208183 - protein, 12 aa, Unknown
  Description of Unknown: mammalian sequence
TETAAAADPGLS

SEQ ID NO: 208184 - protein, 14 aa, Unknown
  Description of Unknown: mammalian sequence
VAESDRPELTSARR

SEQ ID NO: 208185 - protein, 4 aa, Unknown
  Description of Unknown: mammalian sequence
PFYP

SEQ ID NO: 208186 - protein, 6 aa, Unknown
  Description of Unknown: mammalian sequence
GVSEKP

SEQ ID NO: 208187 - protein, 9 aa, Unknown
  Description of Unknown: mammalian sequence
LGMGDVASL

SEQ ID NO: 208188 - protein, 15 aa, Unknown
  Description of Unknown: mammalian sequence
ALGGEARLPVLKDRN

SEQ ID NO: 208189 - protein, 17 aa, Unknown
  Description of Unknown: mammalian sequence
AAGLEAEAPKSAKELSL

SEQ ID NO: 208190 - protein, 4 aa, Unknown
  Description of Unknown: mammalian sequence
KGRF

SEQ ID NO: 208191 - protein, 5 aa, Unknown
  Description of Unknown: mammalian sequence
KAGSL

SEQ ID NO: 208192 - protein, 6 aa, Unknown
  Description of Unknown: mammalian sequence
NTGIFI

SEQ ID NO: 208193 - protein, 6 aa, Unknown
  Description of Unknown: mammalian sequence
QLVKSE

SEQ ID NO: 208194 - protein, 7 aa, Unknown
  Description of Unknown: mammalian sequence
KLKYVPH

SEQ ID NO: 208195 - protein, 7 aa, Unknown
  Description of Unknown: mammalian sequence
LGFDEVI

SEQ ID NO: 208196 - protein, 9 aa, Unknown
  Description of Unknown: mammalian sequence
MLATNLTDK

SEQ ID NO: 208197 - protein, 16 aa, Unknown
  Description of Unknown: mammalian sequence
LKDHILQFVIPNRGVT

SEQ ID NO: 208198 - protein, 17 aa, Unknown
  Description of Unknown: mammalian sequence
RAKGSTKFTRVPKRVYW

SEQ ID NO: 208199 - protein, 5 aa, Unknown
  Description of Unknown: mammalian sequence
FQKLM

SEQ ID NO: 208200 - protein, 6 aa, Unknown
  Description of Unknown: mammalian sequence
NAPTPQ

SEQ ID NO: 208201 - protein, 8 aa, Unknown
  Description of Unknown: mammalian sequence
EFKEGEDA

SEQ ID NO: 208202 - protein, 6 aa, Unknown
  Description of Unknown: mammalian sequence
AGTLLP

SEQ ID NO: 208203 - protein, 6 aa, Unknown
  Description of Unknown: mammalian sequence
LAPYKV

SEQ ID NO: 208204 - protein, 7 aa, Unknown
  Description of Unknown: mammalian sequence
ESIKDDK

SEQ ID NO: 208205 - protein, 7 aa, Unknown
  Description of Unknown: mammalian sequence
FHDKPEI

SEQ ID NO: 208206 - protein, 8 aa, Unknown
  Description of Unknown: mammalian sequence
ITTPKDDE

SEQ ID NO: 208207 - protein, 9 aa, Unknown
  Description of Unknown: mammalian sequence
HDITPSMTP

SEQ ID NO: 208208 - protein, 10 aa, Unknown
  Description of Unknown: mammalian sequence
AEATVAPVSP

SEQ ID NO: 208209 - protein, 11 aa, Unknown
  Description of Unknown: mammalian sequence
IDALADKYEPS

SEQ ID NO: 208210 - protein, 4 aa, Unknown
  Description of Unknown: mammalian sequence
FYGK

SEQ ID NO: 208211 - protein, 8 aa, Unknown
  Description of Unknown: mammalian sequence
ALSNTGEI

SEQ ID NO: 208212 - protein, 15 aa, Unknown
  Description of Unknown: mammalian sequence
TATPPGSVTVPHPNI

SEQ ID NO: 208213 - protein, 19 aa, Unknown
  Description of Unknown: mammalian sequence
RSPVFTDNSSPPAVPQSFQ

SEQ ID NO: 208214 - protein, 8 aa, Unknown
  Description of Unknown: mammalian sequence
IRNIDQDV

SEQ ID NO: 208215 - protein, 8 aa, Unknown
  Description of Unknown: mammalian sequence
REETNLMD

SEQ ID NO: 208216 - protein, 6 aa, Unknown
  Description of Unknown: mammalian sequence
HALPLV

SEQ ID NO: 208217 - protein, 6 aa, Unknown
  Description of Unknown: mammalian sequence
EGRSKK

SEQ ID NO: 208218 - protein, 27 aa, Unknown
  Description of Unknown: mammalian sequence
NKEKKAVSPLLLTTTNSSEGLSMGNYI

SEQ ID NO: 208219 - protein, 7 aa, Unknown
  Description of Unknown: mammalian sequence
DLASGQI

SEQ ID NO: 208220 - protein, 7 aa, Unknown
  Description of Unknown: mammalian sequence
TLANGAV

SEQ ID NO: 208221 - protein, 8 aa, Unknown
  Description of Unknown: mammalian sequence
DYDGYNQF

SEQ ID NO: 208222 - protein, 9 aa, Unknown
  Description of Unknown: mammalian sequence
DTGGAPGTV

SEQ ID NO: 208223 - protein, 9 aa, Unknown
  Description of Unknown: mammalian sequence
QTNGGQFPY

SEQ ID NO: 208224 - protein, 10 aa, Unknown
  Description of Unknown: mammalian sequence
TGIKGAFRTR

SEQ ID NO: 208225 - protein, 5 aa, Unknown
  Description of Unknown: mammalian sequence
SLPAR

SEQ ID NO: 208226 - protein, 4 aa, Unknown
  Description of Unknown: mammalian sequence
IYPD

SEQ ID NO: 208227 - protein, 4 aa, Unknown
  Description of Unknown: mammalian sequence
KCAV

SEQ ID NO: 208228 - protein, 4 aa, Unknown
  Description of Unknown: mammalian sequence
MAPK

SEQ ID NO: 208229 - protein, 4 aa, Unknown
  Description of Unknown: mammalian sequence
TESL

SEQ ID NO: 208230 - protein, 5 aa, Unknown
  Description of Unknown: mammalian sequence
ASADQ

SEQ ID NO: 208231 - protein, 10 aa, Unknown
  Description of Unknown: mammalian sequence
YTLRQPPPAT

SEQ ID NO: 208232 - protein, 11 aa, Unknown
  Description of Unknown: mammalian sequence
DQSDPNDPKSR

SEQ ID NO: 208233 - protein, 24 aa, Unknown
  Description of Unknown: mammalian sequence
SLHDMADEAGLPVQTEDGEATGTI

SEQ ID NO: 208234 - protein, 5 aa, Unknown
  Description of Unknown: mammalian sequence
DGIEE

SEQ ID NO: 208235 - protein, 6 aa, Unknown
  Description of Unknown: mammalian sequence
VEHLPK

SEQ ID NO: 208236 - protein, 4 aa, Unknown
  Description of Unknown: mammalian sequence
QAHS

SEQ ID NO: 208237 - protein, 7 aa, Unknown
  Description of Unknown: mammalian sequence
AKEAFVS

SEQ ID NO: 208238 - protein, 9 aa, Unknown
  Description of Unknown: mammalian sequence
QGILLHRSR

SEQ ID NO: 208239 - protein, 4 aa, Unknown
  Description of Unknown: mammalian sequence
ESEY

SEQ ID NO: 208240 - protein, 5 aa, Unknown
  Description of Unknown: mammalian sequence
DGPTP

SEQ ID NO: 208241 - protein, 8 aa, Unknown
  Description of Unknown: mammalian sequence
VGSEKVSK

SEQ ID NO: 208242 - protein, 4 aa, Unknown
  Description of Unknown: mammalian sequence
IGQS

SEQ ID NO: 208243 - protein, 15 aa, Unknown
  Description of Unknown: mammalian sequence
VSNINNTVSPSSASF

SEQ ID NO: 208244 - protein, 16 aa, Unknown
  Description of Unknown: mammalian sequence
ALPTNARPLLPPISNP

SEQ ID NO: 208245 - protein, 8 aa, Unknown
  Description of Unknown: mammalian sequence
VRERPVPR

SEQ ID NO: 208246 - protein, 9 aa, Unknown
  Description of Unknown: mammalian sequence
EQADGAVRG

SEQ ID NO: 208247 - protein, 13 aa, Unknown
  Description of Unknown: mammalian sequence
ARSGYRPDSGATP

SEQ ID NO: 208248 - protein, 8 aa, Unknown
  Description of Unknown: mammalian sequence
PDIDKLGY

SEQ ID NO: 208249 - protein, 5 aa, Unknown
  Description of Unknown: mammalian sequence
LGYSM

SEQ ID NO: 208250 - protein, 13 aa, Unknown
  Description of Unknown: mammalian sequence
SGVIKKFTAIIDP

SEQ ID NO: 208251 - protein, 6 aa, Unknown
  Description of Unknown: mammalian sequence
RTSRQL

SEQ ID NO: 208252 - protein, 4 aa, Unknown
  Description of Unknown: mammalian sequence
SGCK

SEQ ID NO: 208253 - protein, 5 aa, Unknown
  Description of Unknown: mammalian sequence
VSTGV

SEQ ID NO: 208254 - protein, 10 aa, Unknown
  Description of Unknown: mammalian sequence
QALDGDITDM

SEQ ID NO: 208255 - protein, 8 aa, Unknown
  Description of Unknown: mammalian sequence
HTAGSIPM

SEQ ID NO: 208256 - protein, 8 aa, Unknown
  Description of Unknown: mammalian sequence
WEGHVPHY

SEQ ID NO: 208257 - protein, 9 aa, Unknown
  Description of Unknown: mammalian sequence
VEGKREEAL

SEQ ID NO: 208258 - protein, 13 aa, Unknown
  Description of Unknown: mammalian sequence
PMQTFSKQREVDF

SEQ ID NO: 208259 - protein, 10 aa, Unknown
  Description of Unknown: mammalian sequence
VYFNERINVD

SEQ ID NO: 208260 - protein, 6 aa, Unknown
  Description of Unknown: mammalian sequence
SGGPAT

SEQ ID NO: 208261 - protein, 8 aa, Unknown
  Description of Unknown: mammalian sequence
YAATSTGR

SEQ ID NO: 208262 - protein, 9 aa, Unknown
  Description of Unknown: mammalian sequence
TGGTEAAGG

SEQ ID NO: 208263 - protein, 6 aa, Unknown
  Description of Unknown: mammalian sequence
FDPTEF

SEQ ID NO: 208264 - protein, 7 aa, Unknown
  Description of Unknown: mammalian sequence
VDLDFNR

SEQ ID NO: 208265 - protein, 10 aa, Unknown
  Description of Unknown: mammalian sequence
SNDAGFAMTS

SEQ ID NO: 208266 - protein, 11 aa, Unknown
  Description of Unknown: mammalian sequence
NGFDPATGDLS

SEQ ID NO: 208267 - protein, 8 aa, Unknown
  Description of Unknown: mammalian sequence
FSQPAPDR

SEQ ID NO: 208268 - protein, 5 aa, Unknown
  Description of Unknown: mammalian sequence
CQPNE

SEQ ID NO: 208269 - protein, 5 aa, Unknown
  Description of Unknown: mammalian sequence
KGVPC

SEQ ID NO: 208270 - protein, 5 aa, Unknown
  Description of Unknown: mammalian sequence
PFITE

SEQ ID NO: 208271 - protein, 6 aa, Unknown
  Description of Unknown: mammalian sequence
SIPTCE

SEQ ID NO: 208272 - protein, 6 aa, Unknown
  Description of Unknown: mammalian sequence
VEEHNI

SEQ ID NO: 208273 - protein, 7 aa, Unknown
  Description of Unknown: mammalian sequence
SNKEVIQ

SEQ ID NO: 208274 - protein, 7 aa, Unknown
  Description of Unknown: mammalian sequence
TAKGDTK

SEQ ID NO: 208275 - protein, 9 aa, Unknown
  Description of Unknown: mammalian sequence
GRWYPAFAD

SEQ ID NO: 208276 - protein, 16 aa, Unknown
  Description of Unknown: mammalian sequence
IFYDFLHVNVIPTVSF

SEQ ID NO: 208277 - protein, 5 aa, Unknown
  Description of Unknown: mammalian sequence
PGPAS

SEQ ID NO: 208278 - protein, 7 aa, Unknown
  Description of Unknown: mammalian sequence
KVSKKTG

SEQ ID NO: 208279 - protein, 8 aa, Unknown
  Description of Unknown: mammalian sequence
ACNIASMP

SEQ ID NO: 208280 - protein, 8 aa, Unknown
  Description of Unknown: mammalian sequence
FNDEASDE

SEQ ID NO: 208281 - protein, 18 aa, Unknown
  Description of Unknown: mammalian sequence
SLNAGELKKAAPADPSAP

SEQ ID NO: 208282 - protein, 10 aa, Unknown
  Description of Unknown: mammalian sequence
DKYYMASPDL

SEQ ID NO: 208283 - protein, 10 aa, Unknown
  Description of Unknown: mammalian sequence
NATNATQPIH

SEQ ID NO: 208284 - protein, 4 aa, Unknown
  Description of Unknown: mammalian sequence
EFPP

SEQ ID NO: 208285 - protein, 9 aa, Unknown
  Description of Unknown: mammalian sequence
ENELMYGVP

SEQ ID NO: 208286 - protein, 13 aa, Unknown
  Description of Unknown: mammalian sequence
QSKDFLIPIGKAK

SEQ ID NO: 208287 - protein, 4 aa, Unknown
  Description of Unknown: mammalian sequence
AGEV

SEQ ID NO: 208288 - protein, 4 aa, Unknown
  Description of Unknown: mammalian sequence
LHPT

SEQ ID NO: 208289 - protein, 4 aa, Unknown
  Description of Unknown: mammalian sequence
RIEA

SEQ ID NO: 208290 - protein, 4 aa, Unknown
  Description of Unknown: mammalian sequence
SPGA

SEQ ID NO: 208291 - protein, 4 aa, Unknown
  Description of Unknown: mammalian sequence
YFTA

SEQ ID NO: 208292 - protein, 6 aa, Unknown
  Description of Unknown: mammalian sequence
DGSTGK

SEQ ID NO: 208293 - protein, 6 aa, Unknown
  Description of Unknown: mammalian sequence
EKGERV

SEQ ID NO: 208294 - protein, 6 aa, Unknown
  Description of Unknown: mammalian sequence
KGDIET

SEQ ID NO: 208295 - protein, 7 aa, Unknown
  Description of Unknown: mammalian sequence
DEGMITE

SEQ ID NO: 208296 - protein, 7 aa, Unknown
  Description of Unknown: mammalian sequence
QEASVSG

SEQ ID NO: 208297 - protein, 4 aa, Unknown
  Description of Unknown: mammalian sequence
EAAN

SEQ ID NO: 208298 - protein, 4 aa, Unknown
  Description of Unknown: mammalian sequence
RYGL

SEQ ID NO: 208299 - protein, 5 aa, Unknown
  Description of Unknown: mammalian sequence
EVLDY

SEQ ID NO: 208300 - protein, 5 aa, Unknown
  Description of Unknown: mammalian sequence
RPFVS

SEQ ID NO: 208301 - protein, 5 aa, Unknown
  Description of Unknown: mammalian sequence
SLVNQ

SEQ ID NO: 208302 - protein, 5 aa, Unknown
  Description of Unknown: mammalian sequence
SMGSS

SEQ ID NO: 208303 - protein, 6 aa, Unknown
  Description of Unknown: mammalian sequence
SKEFSP

SEQ ID NO: 208304 - protein, 7 aa, Unknown
  Description of Unknown: mammalian sequence
AAKGEKI

SEQ ID NO: 208305 - protein, 7 aa, Unknown
  Description of Unknown: mammalian sequence
GAPDAER

SEQ ID NO: 208306 - protein, 7 aa, Unknown
  Description of Unknown: mammalian sequence
RGEAMPK

SEQ ID NO: 208307 - protein, 8 aa, Unknown
  Description of Unknown: mammalian sequence
SGAKKNHF

SEQ ID NO: 208308 - protein, 8 aa, Unknown
  Description of Unknown: mammalian sequence
TGRSYKLF

SEQ ID NO: 208309 - protein, 9 aa, Unknown
  Description of Unknown: mammalian sequence
AALPASAKV

SEQ ID NO: 208310 - protein, 9 aa, Unknown
  Description of Unknown: mammalian sequence
DGFRTSHEI

SEQ ID NO: 208311 - protein, 10 aa, Unknown
  Description of Unknown: mammalian sequence
KSMNPEHPHV

SEQ ID NO: 208312 - protein, 10 aa, Unknown
  Description of Unknown: mammalian sequence
RGTAQNPDIY

SEQ ID NO: 208313 - protein, 11 aa, Unknown
  Description of Unknown: mammalian sequence
WVPENCIQCNQ

SEQ ID NO: 208314 - protein, 12 aa, Unknown
  Description of Unknown: mammalian sequence
DRTKEPGAPGDP

SEQ ID NO: 208315 - protein, 28 aa, Unknown
  Description of Unknown: mammalian sequence
TVGIEDDVTGTSLPVDNAFADTTPKGTI

SEQ ID NO: 208316 - protein, 4 aa, Unknown
  Description of Unknown: mammalian sequence
AGED

SEQ ID NO: 208317 - protein, 4 aa, Unknown
  Description of Unknown: mammalian sequence
DADS

SEQ ID NO: 208318 - protein, 4 aa, Unknown
  Description of Unknown: mammalian sequence
DGTV

SEQ ID NO: 208319 - protein, 4 aa, Unknown
  Description of Unknown: mammalian sequence
QDGR

SEQ ID NO: 208320 - protein, 5 aa, Unknown
  Description of Unknown: mammalian sequence
LGAGE

SEQ ID NO: 208321 - protein, 5 aa, Unknown
  Description of Unknown: mammalian sequence
QPGRG

SEQ ID NO: 208322 - protein, 6 aa, Unknown
  Description of Unknown: mammalian sequence
DFADGS

SEQ ID NO: 208323 - protein, 6 aa, Unknown
  Description of Unknown: mammalian sequence
YDRPDR

SEQ ID NO: 208324 - protein, 7 aa, Unknown
  Description of Unknown: mammalian sequence
KADAAPQ

SEQ ID NO: 208325 - protein, 15 aa, Unknown
  Description of Unknown: mammalian sequence
PLGEAPDAYADDASG

SEQ ID NO: 208326 - protein, 4 aa, Unknown
  Description of Unknown: mammalian sequence
PCFP

SEQ ID NO: 208327 - protein, 7 aa, Unknown
  Description of Unknown: mammalian sequence
DLESPVK

SEQ ID NO: 208328 - protein, 7 aa, Unknown
  Description of Unknown: mammalian sequence
FLRIQNV

SEQ ID NO: 208329 - protein, 10 aa, Unknown
  Description of Unknown: mammalian sequence
LGHPCTRTPH

SEQ ID NO: 208330 - protein, 6 aa, Unknown
  Description of Unknown: mammalian sequence
HFPKTF

SEQ ID NO: 208331 - protein, 7 aa, Unknown
  Description of Unknown: mammalian sequence
RKLLGVK

SEQ ID NO: 208332 - protein, 7 aa, Unknown
  Description of Unknown: mammalian sequence
SATPIPR

SEQ ID NO: 208333 - protein, 8 aa, Unknown
  Description of Unknown: mammalian sequence
FYGDLDVT

SEQ ID NO: 208334 - protein, 8 aa, Unknown
  Description of Unknown: mammalian sequence
SLPFKLTN

SEQ ID NO: 208335 - protein, 9 aa, Unknown
  Description of Unknown: mammalian sequence
CSLKETLPE

SEQ ID NO: 208336 - protein, 9 aa, Unknown
  Description of Unknown: mammalian sequence
ISEKPMNRL

SEQ ID NO: 208337 - protein, 9 aa, Unknown
  Description of Unknown: mammalian sequence
TMLVPMDRV

SEQ ID NO: 208338 - protein, 10 aa, Unknown
  Description of Unknown: mammalian sequence
IYRLTSGISQ

SEQ ID NO: 208339 - protein, 11 aa, Unknown
  Description of Unknown: mammalian sequence
HGGIPKKIEGK

SEQ ID NO: 208340 - protein, 12 aa, Unknown
  Description of Unknown: mammalian sequence
IDEMPPGRKEVQ

SEQ ID NO: 208341 - protein, 12 aa, Unknown
  Description of Unknown: mammalian sequence
TPKEGEYVRRIL

SEQ ID NO: 208342 - protein, 9 aa, Unknown
  Description of Unknown: mammalian sequence
KSDYTQNNI

SEQ ID NO: 208343 - protein, 15 aa, Unknown
  Description of Unknown: mammalian sequence
EGMGPVLAPVTPVPV

SEQ ID NO: 208344 - protein, 7 aa, Unknown
  Description of Unknown: mammalian sequence
MLNQNWH

SEQ ID NO: 208345 - protein, 10 aa, Unknown
  Description of Unknown: mammalian sequence
NMTNATDASP

SEQ ID NO: 208346 - protein, 14 aa, Unknown
  Description of Unknown: mammalian sequence
LLYDERTTNLTLDE

SEQ ID NO: 208347 - protein, 6 aa, Unknown
  Description of Unknown: mammalian sequence
EAGYPG

SEQ ID NO: 208348 - protein, 7 aa, Unknown
  Description of Unknown: mammalian sequence
LFDSLSP

SEQ ID NO: 208349 - protein, 7 aa, Unknown
  Description of Unknown: mammalian sequence
TREGKST

SEQ ID NO: 208350 - protein, 5 aa, Unknown
  Description of Unknown: mammalian sequence
AEGDM

SEQ ID NO: 208351 - protein, 6 aa, Unknown
  Description of Unknown: mammalian sequence
AALDKK

SEQ ID NO: 208352 - protein, 6 aa, Unknown
  Description of Unknown: mammalian sequence
ENEGLE

SEQ ID NO: 208353 - protein, 7 aa, Unknown
  Description of Unknown: mammalian sequence
RFRPLRD

SEQ ID NO: 208354 - protein, 7 aa, Unknown
  Description of Unknown: mammalian sequence
VASRARP

SEQ ID NO: 208355 - protein, 4 aa, Unknown
  Description of Unknown: mammalian sequence
TKNI

SEQ ID NO: 208356 - protein, 6 aa, Unknown
  Description of Unknown: mammalian sequence
VSAGST

SEQ ID NO: 208357 - protein, 9 aa, Unknown
  Description of Unknown: mammalian sequence
SGSVKTGTT

SEQ ID NO: 208358 - protein, 10 aa, Unknown
  Description of Unknown: mammalian sequence
DLDIKGYVAA

SEQ ID NO: 208359 - protein, 13 aa, Unknown
  Description of Unknown: mammalian sequence
SRSGTPSTSIDTS

SEQ ID NO: 208360 - protein, 9 aa, Unknown
  Description of Unknown: mammalian sequence
CDGDEYKPV

SEQ ID NO: 208361 - protein, 14 aa, Unknown
  Description of Unknown: mammalian sequence
DGPCEPDEDEDVCQ

SEQ ID NO: 208362 - protein, 14 aa, Unknown
  Description of Unknown: mammalian sequence
RAVLSSTRMGGHFV

SEQ ID NO: 208363 - protein, 4 aa, Unknown
  Description of Unknown: mammalian sequence
QLRT

SEQ ID NO: 208364 - protein, 5 aa, Unknown
  Description of Unknown: mammalian sequence
DITNA

SEQ ID NO: 208365 - protein, 6 aa, Unknown
  Description of Unknown: mammalian sequence
QEVVAP

SEQ ID NO: 208366 - protein, 4 aa, Unknown
  Description of Unknown: mammalian sequence
ILGE

SEQ ID NO: 208367 - protein, 5 aa, Unknown
  Description of Unknown: mammalian sequence
SQGGK

SEQ ID NO: 208368 - protein, 6 aa, Unknown
  Description of Unknown: mammalian sequence
IARPPA

SEQ ID NO: 208369 - protein, 7 aa, Unknown
  Description of Unknown: mammalian sequence
PTFAVER

SEQ ID NO: 208370 - protein, 12 aa, Unknown
  Description of Unknown: mammalian sequence
EGTYGDRPHRPY

SEQ ID NO: 208371 - protein, 24 aa, Unknown
  Description of Unknown: mammalian sequence
YSGDLGNREKDVLPDPSLPPLADL

SEQ ID NO: 208372 - protein, 4 aa, Unknown
  Description of Unknown: mammalian sequence
DYTE

SEQ ID NO: 208373 - protein, 4 aa, Unknown
  Description of Unknown: mammalian sequence
TFSY

SEQ ID NO: 208374 - protein, 6 aa, Unknown
  Description of Unknown: mammalian sequence
DTFIDH

SEQ ID NO: 208375 - protein, 8 aa, Unknown
  Description of Unknown: mammalian sequence
EMGKYDNH

SEQ ID NO: 208376 - protein, 9 aa, Unknown
  Description of Unknown: mammalian sequence
YGQFEPPAL

SEQ ID NO: 208377 - protein, 16 aa, Unknown
  Description of Unknown: mammalian sequence
KYLVQNRVTGEIYESA

SEQ ID NO: 208378 - protein, 13 aa, Unknown
  Description of Unknown: mammalian sequence
DLSVFPELEEGDY

SEQ ID NO: 208379 - protein, 9 aa, Unknown
  Description of Unknown: mammalian sequence
DYGFIEPNE

SEQ ID NO: 208380 - protein, 6 aa, Unknown
  Description of Unknown: mammalian sequence
KSGEDI

SEQ ID NO: 208381 - protein, 29 aa, Unknown
  Description of Unknown: mammalian sequence
INQGEDSVPAKKFKAAPAEISDGEDRSKC

SEQ ID NO: 208382 - protein, 5 aa, Unknown
  Description of Unknown: mammalian sequence
RSPEW

SEQ ID NO: 208383 - protein, 19 aa, Unknown
  Description of Unknown: mammalian sequence
SAFGIRPPLRLGEFTMPEH

SEQ ID NO: 208384 - protein, 12 aa, Unknown
  Description of Unknown: mammalian sequence
LNTGASDNFTRW

SEQ ID NO: 208385 - protein, 12 aa, Unknown
  Description of Unknown: mammalian sequence
AEKGEDIEIKKV

SEQ ID NO: 208386 - protein, 15 aa, Unknown
  Description of Unknown: mammalian sequence
VDRADPLEQGAGDQG

SEQ ID NO: 208387 - protein, 4 aa, Unknown
  Description of Unknown: mammalian sequence
DGDF

SEQ ID NO: 208388 - protein, 4 aa, Unknown
  Description of Unknown: mammalian sequence
KNDK

SEQ ID NO: 208389 - protein, 4 aa, Unknown
  Description of Unknown: mammalian sequence
PIRS

SEQ ID NO: 208390 - protein, 4 aa, Unknown
  Description of Unknown: mammalian sequence
PMTG

SEQ ID NO: 208391 - protein, 4 aa, Unknown
  Description of Unknown: mammalian sequence
RACC

SEQ ID NO: 208392 - protein, 4 aa, Unknown
  Description of Unknown: mammalian sequence
VGTT

SEQ ID NO: 208393 - protein, 5 aa, Unknown
  Description of Unknown: mammalian sequence
DAGIR

SEQ ID NO: 208394 - protein, 5 aa, Unknown
  Description of Unknown: mammalian sequence
DDLPL

SEQ ID NO: 208395 - protein, 5 aa, Unknown
  Description of Unknown: mammalian sequence
GCTSV

SEQ ID NO: 208396 - protein, 5 aa, Unknown
  Description of Unknown: mammalian sequence
ITAFV

SEQ ID NO: 208397 - protein, 5 aa, Unknown
  Description of Unknown: mammalian sequence
TASEM

SEQ ID NO: 208398 - protein, 5 aa, Unknown
  Description of Unknown: mammalian sequence
TGDNK

SEQ ID NO: 208399 - protein, 5 aa, Unknown
  Description of Unknown: mammalian sequence
YETDL

SEQ ID NO: 208400 - protein, 6 aa, Unknown
  Description of Unknown: mammalian sequence
LADDNF

SEQ ID NO: 208401 - protein, 6 aa, Unknown
  Description of Unknown: mammalian sequence
MGSGTA

SEQ ID NO: 208402 - protein, 7 aa, Unknown
  Description of Unknown: mammalian sequence
ARVEPSH

SEQ ID NO: 208403 - protein, 7 aa, Unknown
  Description of Unknown: mammalian sequence
EMVLDDS

SEQ ID NO: 208404 - protein, 7 aa, Unknown
  Description of Unknown: mammalian sequence
RDTPPKR

SEQ ID NO: 208405 - protein, 7 aa, Unknown
  Description of Unknown: mammalian sequence
TGRDTLR

SEQ ID NO: 208406 - protein, 8 aa, Unknown
  Description of Unknown: mammalian sequence
LDPPRKEV

SEQ ID NO: 208407 - protein, 9 aa, Unknown
  Description of Unknown: mammalian sequence
LAWFEEGEE

SEQ ID NO: 208408 - protein, 10 aa, Unknown
  Description of Unknown: mammalian sequence
ALGLPEALIP

SEQ ID NO: 208409 - protein, 12 aa, Unknown
  Description of Unknown: mammalian sequence
DKTGTLTTNQMS

SEQ ID NO: 208410 - protein, 12 aa, Unknown
  Description of Unknown: mammalian sequence
ITGSTYAPEGEV

SEQ ID NO: 208411 - protein, 14 aa, Unknown
  Description of Unknown: mammalian sequence
IGIFGENEEVADRA

SEQ ID NO: 208412 - protein, 6 aa, Unknown
  Description of Unknown: mammalian sequence
YLRQDL

SEQ ID NO: 208413 - protein, 8 aa, Unknown
  Description of Unknown: mammalian sequence
ESQSLSIQ

SEQ ID NO: 208414 - protein, 6 aa, Unknown
  Description of Unknown: mammalian sequence
SGKQSY

SEQ ID NO: 208415 - protein, 14 aa, Unknown
  Description of Unknown: mammalian sequence
FRARGKAVSTVFDQ

SEQ ID NO: 208416 - protein, 6 aa, Unknown
  Description of Unknown: mammalian sequence
DANSEM

SEQ ID NO: 208417 - protein, 7 aa, Unknown
  Description of Unknown: mammalian sequence
DITAQKE

SEQ ID NO: 208418 - protein, 8 aa, Unknown
  Description of Unknown: mammalian sequence
TVESTGKV

SEQ ID NO: 208419 - protein, 5 aa, Unknown
  Description of Unknown: mammalian sequence
AQDRK

SEQ ID NO: 208420 - protein, 4 aa, Unknown
  Description of Unknown: mammalian sequence
FYGK

SEQ ID NO: 208421 - protein, 8 aa, Unknown
  Description of Unknown: mammalian sequence
ALSSTGEI

SEQ ID NO: 208422 - protein, 15 aa, Unknown
  Description of Unknown: mammalian sequence
TATPPGSVTVPHPNI

SEQ ID NO: 208423 - protein, 17 aa, Unknown
  Description of Unknown: mammalian sequence
LLQVPLPPWPGAPVGGE

SEQ ID NO: 208424 - protein, 6 aa, Unknown
  Description of Unknown: mammalian sequence
FRGPDR

SEQ ID NO: 208425 - protein, 4 aa, Unknown
  Description of Unknown: mammalian sequence
EGGK

SEQ ID NO: 208426 - protein, 6 aa, Unknown
  Description of Unknown: mammalian sequence
INDKYE

SEQ ID NO: 208427 - protein, 6 aa, Unknown
  Description of Unknown: mammalian sequence
NETTNK

SEQ ID NO: 208428 - protein, 8 aa, Unknown
  Description of Unknown: mammalian sequence
DFDSGSLR

SEQ ID NO: 208429 - protein, 9 aa, Unknown
  Description of Unknown: mammalian sequence
KNGDNDFRY

SEQ ID NO: 208430 - protein, 11 aa, Unknown
  Description of Unknown: mammalian sequence
PMNVFYKDSLF

SEQ ID NO: 208431 - protein, 4 aa, Unknown
  Description of Unknown: mammalian sequence
GGEA

SEQ ID NO: 208432 - protein, 4 aa, Unknown
  Description of Unknown: mammalian sequence
LGDV

SEQ ID NO: 208433 - protein, 5 aa, Unknown
  Description of Unknown: mammalian sequence
YSNVE

SEQ ID NO: 208434 - protein, 6 aa, Unknown
  Description of Unknown: mammalian sequence
DPVSKE

SEQ ID NO: 208435 - protein, 6 aa, Unknown
  Description of Unknown: mammalian sequence
GLPGDK

SEQ ID NO: 208436 - protein, 6 aa, Unknown
  Description of Unknown: mammalian sequence
IVPPGQ

SEQ ID NO: 208437 - protein, 9 aa, Unknown
  Description of Unknown: mammalian sequence
TVPIAQDQV

SEQ ID NO: 208438 - protein, 11 aa, Unknown
  Description of Unknown: mammalian sequence
EVPKNETKENG

SEQ ID NO: 208439 - protein, 12 aa, Unknown
  Description of Unknown: mammalian sequence
MYYQQPGQQLAT

SEQ ID NO: 208440 - protein, 16 aa, Unknown
  Description of Unknown: mammalian sequence
QPGCSSGQACENALPV

SEQ ID NO: 208441 - protein, 15 aa, Unknown
  Description of Unknown: mammalian sequence
ALGGEARLPVLKDRN

SEQ ID NO: 208442 - protein, 8 aa, Unknown
  Description of Unknown: mammalian sequence
KYTYEHDP

SEQ ID NO: 208443 - protein, 10 aa, Unknown
  Description of Unknown: mammalian sequence
IGGPPNACLD

SEQ ID NO: 208444 - protein, 20 aa, Unknown
  Description of Unknown: mammalian sequence
ENAQRFNQAQSGNIQSTVML

SEQ ID NO: 208445 - protein, 25 aa, Unknown
  Description of Unknown: mammalian sequence
LQNREHETNGVAKSDQKQEQLLLKK

SEQ ID NO: 208446 - protein, 9 aa, Unknown
  Description of Unknown: mammalian sequence
CEMGSTFQL

SEQ ID NO: 208447 - protein, 26 aa, Unknown
  Description of Unknown: mammalian sequence
PDGRNQNPDLTGLCEPTPQDHIKVTQ

SEQ ID NO: 208448 - protein, 4 aa, Unknown
  Description of Unknown: mammalian sequence
LGTA

SEQ ID NO: 208449 - protein, 4 aa, Unknown
  Description of Unknown: mammalian sequence
NHPA

SEQ ID NO: 208450 - protein, 5 aa, Unknown
  Description of Unknown: mammalian sequence
CNLTP

SEQ ID NO: 208451 - protein, 5 aa, Unknown
  Description of Unknown: mammalian sequence
IRRTS

SEQ ID NO: 208452 - protein, 6 aa, Unknown
  Description of Unknown: mammalian sequence
KYLPVK

SEQ ID NO: 208453 - protein, 7 aa, Unknown
  Description of Unknown: mammalian sequence
ISGTPIQ

SEQ ID NO: 208454 - protein, 8 aa, Unknown
  Description of Unknown: mammalian sequence
RDADASDK

SEQ ID NO: 208455 - protein, 9 aa, Unknown
  Description of Unknown: mammalian sequence
TGEEGFDGA

SEQ ID NO: 208456 - protein, 10 aa, Unknown
  Description of Unknown: mammalian sequence
ESLQTGKISV

SEQ ID NO: 208457 - protein, 14 aa, Unknown
  Description of Unknown: mammalian sequence
DLFPQNYSTKAVEP

SEQ ID NO: 208458 - protein, 4 aa, Unknown
  Description of Unknown: mammalian sequence
SATH

SEQ ID NO: 208459 - protein, 7 aa, Unknown
  Description of Unknown: mammalian sequence
YIPLPEP

SEQ ID NO: 208460 - protein, 8 aa, Unknown
  Description of Unknown: mammalian sequence
RKTDGYSG

SEQ ID NO: 208461 - protein, 9 aa, Unknown
  Description of Unknown: mammalian sequence
PSRADPNHL

SEQ ID NO: 208462 - protein, 10 aa, Unknown
  Description of Unknown: mammalian sequence
LGTTQNSLTE

SEQ ID NO: 208463 - protein, 9 aa, Unknown
  Description of Unknown: mammalian sequence
NLLGQQPLV

SEQ ID NO: 208464 - protein, 10 aa, Unknown
  Description of Unknown: mammalian sequence
SSYGPASGPL

SEQ ID NO: 208465 - protein, 11 aa, Unknown
  Description of Unknown: mammalian sequence
VAQLPKKQVYI

SEQ ID NO: 208466 - protein, 16 aa, Unknown
  Description of Unknown: mammalian sequence
SATPQGQTAKIEVPHT

SEQ ID NO: 208467 - protein, 4 aa, Unknown
  Description of Unknown: mammalian sequence
FSCS

SEQ ID NO: 208468 - protein, 8 aa, Unknown
  Description of Unknown: mammalian sequence
FWLAIDMS

SEQ ID NO: 208469 - protein, 9 aa, Unknown
  Description of Unknown: mammalian sequence
VKAAPQAPV

SEQ ID NO: 208470 - protein, 13 aa, Unknown
  Description of Unknown: mammalian sequence
ADQSESQMIPKDS

SEQ ID NO: 208471 - protein, 4 aa, Unknown
  Description of Unknown: mammalian sequence
FAFI

SEQ ID NO: 208472 - protein, 4 aa, Unknown
  Description of Unknown: mammalian sequence
IQNT

SEQ ID NO: 208473 - protein, 5 aa, Unknown
  Description of Unknown: mammalian sequence
GTLSP

SEQ ID NO: 208474 - protein, 6 aa, Unknown
  Description of Unknown: mammalian sequence
QVPQDD

SEQ ID NO: 208475 - protein, 8 aa, Unknown
  Description of Unknown: mammalian sequence
HLSAGCPH

SEQ ID NO: 208476 - protein, 11 aa, Unknown
  Description of Unknown: mammalian sequence
FSTRVLPAQAT

SEQ ID NO: 208477 - protein, 4 aa, Unknown
  Description of Unknown: mammalian sequence
EMDS

SEQ ID NO: 208478 - protein, 5 aa, Unknown
  Description of Unknown: mammalian sequence
HFPLK

SEQ ID NO: 208479 - protein, 6 aa, Unknown
  Description of Unknown: mammalian sequence
DLDNVT

SEQ ID NO: 208480 - protein, 6 aa, Unknown
  Description of Unknown: mammalian sequence
FDGQLE

SEQ ID NO: 208481 - protein, 7 aa, Unknown
  Description of Unknown: mammalian sequence
ITNECQW

SEQ ID NO: 208482 - protein, 7 aa, Unknown
  Description of Unknown: mammalian sequence
SQPFPVV

SEQ ID NO: 208483 - protein, 7 aa, Unknown
  Description of Unknown: mammalian sequence
TGARSNF

SEQ ID NO: 208484 - protein, 8 aa, Unknown
  Description of Unknown: mammalian sequence
ESDASNPF

SEQ ID NO: 208485 - protein, 8 aa, Unknown
  Description of Unknown: mammalian sequence
HFFGNRSI

SEQ ID NO: 208486 - protein, 9 aa, Unknown
  Description of Unknown: mammalian sequence
QPIYPATLT

SEQ ID NO: 208487 - protein, 10 aa, Unknown
  Description of Unknown: mammalian sequence
FLAGTRKCSV

SEQ ID NO: 208488 - protein, 12 aa, Unknown
  Description of Unknown: mammalian sequence
LNPQHSAPKPNV

SEQ ID NO: 208489 - protein, 12 aa, Unknown
  Description of Unknown: mammalian sequence
SKGKQLGENQLV

SEQ ID NO: 208490 - protein, 15 aa, Unknown
  Description of Unknown: mammalian sequence
ATKQDPVRPKRPLSS

SEQ ID NO: 208491 - protein, 16 aa, Unknown
  Description of Unknown: mammalian sequence
ICDSHPTNKNNPTTPL

SEQ ID NO: 208492 - protein, 9 aa, Unknown
  Description of Unknown: mammalian sequence
YLDTKPAPV

SEQ ID NO: 208493 - protein, 4 aa, Unknown
  Description of Unknown: mammalian sequence
IHKK

SEQ ID NO: 208494 - protein, 5 aa, Unknown
  Description of Unknown: mammalian sequence
GIMPG

SEQ ID NO: 208495 - protein, 5 aa, Unknown
  Description of Unknown: mammalian sequence
NPGEC

SEQ ID NO: 208496 - protein, 7 aa, Unknown
  Description of Unknown: mammalian sequence
IGPNCPG

SEQ ID NO: 208497 - protein, 8 aa, Unknown
  Description of Unknown: mammalian sequence
CITEGIPQ

SEQ ID NO: 208498 - protein, 8 aa, Unknown
  Description of Unknown: mammalian sequence
LLRQGKTR

SEQ ID NO: 208499 - protein, 4 aa, Unknown
  Description of Unknown: mammalian sequence
MRDQ

SEQ ID NO: 208500 - protein, 4 aa, Unknown
  Description of Unknown: mammalian sequence
QEDP

SEQ ID NO: 208501 - protein, 5 aa, Unknown
  Description of Unknown: mammalian sequence
CLDGK

SEQ ID NO: 208502 - protein, 5 aa, Unknown
  Description of Unknown: mammalian sequence
QWELN

SEQ ID NO: 208503 - protein, 6 aa, Unknown
  Description of Unknown: mammalian sequence
ALDGNI

SEQ ID NO: 208504 - protein, 6 aa, Unknown
  Description of Unknown: mammalian sequence
TKQGDL

SEQ ID NO: 208505 - protein, 31 aa, Unknown
  Description of Unknown: mammalian sequence
KGEKYEKRIERLSVRKEEDVKTRSGKLGDNV

SEQ ID NO: 208506 - protein, 27 aa, Unknown
  Description of Unknown: mammalian sequence
AEDRPLSRELPAPAGGPVALSLHDEPT

SEQ ID NO: 208507 - protein, 9 aa, Unknown
  Description of Unknown: mammalian sequence
PYQKTSIPK

SEQ ID NO: 208508 - protein, 9 aa, Unknown
  Description of Unknown: mammalian sequence
RGAGKPNSS

SEQ ID NO: 208509 - protein, 6 aa, Unknown
  Description of Unknown: mammalian sequence
AVGKNP

SEQ ID NO: 208510 - protein, 6 aa, Unknown
  Description of Unknown: mammalian sequence
DTATNT

SEQ ID NO: 208511 - protein, 6 aa, Unknown
  Description of Unknown: mammalian sequence
FLSEPV

SEQ ID NO: 208512 - protein, 6 aa, Unknown
  Description of Unknown: mammalian sequence
LSFCNT

SEQ ID NO: 208513 - protein, 7 aa, Unknown
  Description of Unknown: mammalian sequence
SNITSGY

SEQ ID NO: 208514 - protein, 7 aa, Unknown
  Description of Unknown: mammalian sequence
VTPDGKK

SEQ ID NO: 208515 - protein, 7 aa, Unknown
  Description of Unknown: mammalian sequence
YASGQFI

SEQ ID NO: 208516 - protein, 13 aa, Unknown
  Description of Unknown: mammalian sequence
SIPVQPVYPSADF

SEQ ID NO: 208517 - protein, 7 aa, Unknown
  Description of Unknown: mammalian sequence
EIPTSNI

SEQ ID NO: 208518 - protein, 8 aa, Unknown
  Description of Unknown: mammalian sequence
KADFPTPS

SEQ ID NO: 208519 - protein, 10 aa, Unknown
  Description of Unknown: mammalian sequence
HPYIQNPDPA

SEQ ID NO: 208520 - protein, 11 aa, Unknown
  Description of Unknown: mammalian sequence
DTPPNFLDDDM

SEQ ID NO: 208521 - protein, 7 aa, Unknown
  Description of Unknown: mammalian sequence
FCKALNP

SEQ ID NO: 208522 - protein, 13 aa, Unknown
  Description of Unknown: mammalian sequence
HHDYSLPAAGESW

SEQ ID NO: 208523 - protein, 4 aa, Unknown
  Description of Unknown: mammalian sequence
AEGV

SEQ ID NO: 208524 - protein, 7 aa, Unknown
  Description of Unknown: mammalian sequence
LMLIADV

SEQ ID NO: 208525 - protein, 8 aa, Unknown
  Description of Unknown: mammalian sequence
EAGEEGEK

SEQ ID NO: 208526 - protein, 22 aa, Unknown
  Description of Unknown: mammalian sequence
RSTPPPEMPKPVPRKEVQAGVE

SEQ ID NO: 208527 - protein, 6 aa, Unknown
  Description of Unknown: mammalian sequence
CVPLVR

SEQ ID NO: 208528 - protein, 6 aa, Unknown
  Description of Unknown: mammalian sequence
KSDPIQ

SEQ ID NO: 208529 - protein, 4 aa, Unknown
  Description of Unknown: mammalian sequence
AGVE

SEQ ID NO: 208530 - protein, 12 aa, Unknown
  Description of Unknown: mammalian sequence
NAGGELFRDVNV

SEQ ID NO: 208531 - protein, 17 aa, Unknown
  Description of Unknown: mammalian sequence
ERGAWSAPLPRQPRADT

SEQ ID NO: 208532 - protein, 19 aa, Unknown
  Description of Unknown: mammalian sequence
LAGQQLEHGQTRRFGAISQ

SEQ ID NO: 208533 - protein, 4 aa, Unknown
  Description of Unknown: mammalian sequence
IDNG

SEQ ID NO: 208534 - protein, 4 aa, Unknown
  Description of Unknown: mammalian sequence
KVSW

SEQ ID NO: 208535 - protein, 5 aa, Unknown
  Description of Unknown: mammalian sequence
NRGES

SEQ ID NO: 208536 - protein, 6 aa, Unknown
  Description of Unknown: mammalian sequence
ITAKDE

SEQ ID NO: 208537 - protein, 6 aa, Unknown
  Description of Unknown: mammalian sequence
LWPHTK

SEQ ID NO: 208538 - protein, 6 aa, Unknown
  Description of Unknown: mammalian sequence
MAIGPV

SEQ ID NO: 208539 - protein, 8 aa, Unknown
  Description of Unknown: mammalian sequence
AEKNYDVI

SEQ ID NO: 208540 - protein, 8 aa, Unknown
  Description of Unknown: mammalian sequence
DLDRTLTQ

SEQ ID NO: 208541 - protein, 9 aa, Unknown
  Description of Unknown: mammalian sequence
NIAHDDKPG

SEQ ID NO: 208542 - protein, 4 aa, Unknown
  Description of Unknown: mammalian sequence
FFDK

SEQ ID NO: 208543 - protein, 6 aa, Unknown
  Description of Unknown: mammalian sequence
LFSNDE

SEQ ID NO: 208544 - protein, 6 aa, Unknown
  Description of Unknown: mammalian sequence
VTPGSE

SEQ ID NO: 208545 - protein, 7 aa, Unknown
  Description of Unknown: mammalian sequence
ERKERDH

SEQ ID NO: 208546 - protein, 12 aa, Unknown
  Description of Unknown: mammalian sequence
FDIDQNISSDDF

SEQ ID NO: 208547 - protein, 17 aa, Unknown
  Description of Unknown: mammalian sequence
ELIDAIPEDENVTLYSQ

SEQ ID NO: 208548 - protein, 19 aa, Unknown
  Description of Unknown: mammalian sequence
TMKQIVNENMKIERKVVSR

SEQ ID NO: 208549 - protein, 23 aa, Unknown
  Description of Unknown: mammalian sequence
AHAIKRLYGNVKFGVGPVIEGGF

SEQ ID NO: 208550 - protein, 21 aa, Unknown
  Description of Unknown: mammalian sequence
INGGWGPWSPWDICSVTCGGG

SEQ ID NO: 208551 - protein, 16 aa, Unknown
  Description of Unknown: mammalian sequence
LKMKGLTYTMCDKTKF

SEQ ID NO: 208552 - protein, 7 aa, Unknown
  Description of Unknown: mammalian sequence
LRGEVVS

SEQ ID NO: 208553 - protein, 10 aa, Unknown
  Description of Unknown: mammalian sequence
IHLPKTLEGM

SEQ ID NO: 208554 - protein, 4 aa, Unknown
  Description of Unknown: mammalian sequence
PYPV

SEQ ID NO: 208555 - protein, 14 aa, Unknown
  Description of Unknown: mammalian sequence
LNKEGEPTKQRTRD

SEQ ID NO: 208556 - protein, 11 aa, Unknown
  Description of Unknown: mammalian sequence
RFRDRLPEKLR

SEQ ID NO: 208557 - protein, 12 aa, Unknown
  Description of Unknown: mammalian sequence
DAPQQDPEGNKT

SEQ ID NO: 208558 - protein, 4 aa, Unknown
  Description of Unknown: mammalian sequence
ELPL

SEQ ID NO: 208559 - protein, 4 aa, Unknown
  Description of Unknown: mammalian sequence
VHGK

SEQ ID NO: 208560 - protein, 5 aa, Unknown
  Description of Unknown: mammalian sequence
TNTEK

SEQ ID NO: 208561 - protein, 9 aa, Unknown
  Description of Unknown: mammalian sequence
DSPLKYWPK

SEQ ID NO: 208562 - protein, 12 aa, Unknown
  Description of Unknown: mammalian sequence
SCSEPRCFNGGT

SEQ ID NO: 208563 - protein, 4 aa, Unknown
  Description of Unknown: mammalian sequence
IDGK

SEQ ID NO: 208564 - protein, 5 aa, Unknown
  Description of Unknown: mammalian sequence
PLEGT

SEQ ID NO: 208565 - protein, 9 aa, Unknown
  Description of Unknown: mammalian sequence
AMPGWQDKV

SEQ ID NO: 208566 - protein, 8 aa, Unknown
  Description of Unknown: mammalian sequence
YKKTARPK

SEQ ID NO: 208567 - protein, 12 aa, Unknown
  Description of Unknown: mammalian sequence
TWAPHPRPLPQA

SEQ ID NO: 208568 - protein, 7 aa, Unknown
  Description of Unknown: mammalian sequence
ELNEEMP

SEQ ID NO: 208569 - protein, 17 aa, Unknown
  Description of Unknown: mammalian sequence
IVDYSPQQEGKVFFGAW

SEQ ID NO: 208570 - protein, 6 aa, Unknown
  Description of Unknown: mammalian sequence
QRVRNR

SEQ ID NO: 208571 - protein, 5 aa, Unknown
  Description of Unknown: mammalian sequence
LFVKP

SEQ ID NO: 208572 - protein, 6 aa, Unknown
  Description of Unknown: mammalian sequence
NLNLTP

SEQ ID NO: 208573 - protein, 18 aa, Unknown
  Description of Unknown: mammalian sequence
YSKKAPPQEEIEFVGEHP

SEQ ID NO: 208574 - protein, 4 aa, Unknown
  Description of Unknown: mammalian sequence
IHSP

SEQ ID NO: 208575 - protein, 4 aa, Unknown
  Description of Unknown: mammalian sequence
LTDS

SEQ ID NO: 208576 - protein, 5 aa, Unknown
  Description of Unknown: mammalian sequence
KDGRL

SEQ ID NO: 208577 - protein, 9 aa, Unknown
  Description of Unknown: mammalian sequence
ARINEREET

SEQ ID NO: 208578 - protein, 19 aa, Unknown
  Description of Unknown: mammalian sequence
LWNCAPPQSEVVYRPLVSL

SEQ ID NO: 208579 - protein, 5 aa, Unknown
  Description of Unknown: mammalian sequence
EFPEV

SEQ ID NO: 208580 - protein, 7 aa, Unknown
  Description of Unknown: mammalian sequence
RTASHSI

SEQ ID NO: 208581 - protein, 21 aa, Unknown
  Description of Unknown: mammalian sequence
EDGVIRRRVALLDPVKVNTKV

SEQ ID NO: 208582 - protein, 9 aa, Unknown
  Description of Unknown: mammalian sequence
VLAGGKSGV

SEQ ID NO: 208583 - protein, 4 aa, Unknown
  Description of Unknown: mammalian sequence
QKHV

SEQ ID NO: 208584 - protein, 5 aa, Unknown
  Description of Unknown: mammalian sequence
VAPLI

SEQ ID NO: 208585 - protein, 6 aa, Unknown
  Description of Unknown: mammalian sequence
AADTGL

SEQ ID NO: 208586 - protein, 6 aa, Unknown
  Description of Unknown: mammalian sequence
FANDPQ

SEQ ID NO: 208587 - protein, 6 aa, Unknown
  Description of Unknown: mammalian sequence
LLDHHQ

SEQ ID NO: 208588 - protein, 9 aa, Unknown
  Description of Unknown: mammalian sequence
SSPHALGVI

SEQ ID NO: 208589 - protein, 11 aa, Unknown
  Description of Unknown: mammalian sequence
SERSFPDDLNM

SEQ ID NO: 208590 - protein, 21 aa, Unknown
  Description of Unknown: mammalian sequence
DMGYLGPDPVARSLRTRRAGA

SEQ ID NO: 208591 - protein, 4 aa, Unknown
  Description of Unknown: mammalian sequence
ELPL

SEQ ID NO: 208592 - protein, 5 aa, Unknown
  Description of Unknown: mammalian sequence
EMPSL

SEQ ID NO: 208593 - protein, 5 aa, Unknown
  Description of Unknown: mammalian sequence
RREDI

SEQ ID NO: 208594 - protein, 8 aa, Unknown
  Description of Unknown: mammalian sequence
IHYDWPGN

SEQ ID NO: 208595 - protein, 9 aa, Unknown
  Description of Unknown: mammalian sequence
LLTGEYISE

SEQ ID NO: 208596 - protein, 11 aa, Unknown
  Description of Unknown: mammalian sequence
RNRKVVKGFTP

SEQ ID NO: 208597 - protein, 17 aa, Unknown
  Description of Unknown: mammalian sequence
IAATPIKTEYSGEIQPL

SEQ ID NO: 208598 - protein, 4 aa, Unknown
  Description of Unknown: mammalian sequence
NQYR

SEQ ID NO: 208599 - protein, 7 aa, Unknown
  Description of Unknown: mammalian sequence
EMGLSLQ

SEQ ID NO: 208600 - protein, 7 aa, Unknown
  Description of Unknown: mammalian sequence
KDSAQNS

SEQ ID NO: 208601 - protein, 11 aa, Unknown
  Description of Unknown: mammalian sequence
HDVELNLDYEE

SEQ ID NO: 208602 - protein, 5 aa, Unknown
  Description of Unknown: mammalian sequence
PVDAQ

SEQ ID NO: 208603 - protein, 5 aa, Unknown
  Description of Unknown: mammalian sequence
VPIIE

SEQ ID NO: 208604 - protein, 7 aa, Unknown
  Description of Unknown: mammalian sequence
GVFDGGK

SEQ ID NO: 208605 - protein, 4 aa, Unknown
  Description of Unknown: mammalian sequence
YLRE

SEQ ID NO: 208606 - protein, 6 aa, Unknown
  Description of Unknown: mammalian sequence
IEEDSP

SEQ ID NO: 208607 - protein, 5 aa, Unknown
  Description of Unknown: mammalian sequence
RKSFL

SEQ ID NO: 208608 - protein, 7 aa, Unknown
  Description of Unknown: mammalian sequence
DILDDDR

SEQ ID NO: 208609 - protein, 7 aa, Unknown
  Description of Unknown: mammalian sequence
SGKGGDK

SEQ ID NO: 208610 - protein, 15 aa, Unknown
  Description of Unknown: mammalian sequence
MGGTFTDKDPFRSGR

SEQ ID NO: 208611 - protein, 4 aa, Unknown
  Description of Unknown: mammalian sequence
VEER

SEQ ID NO: 208612 - protein, 7 aa, Unknown
  Description of Unknown: mammalian sequence
ELPELTA

SEQ ID NO: 208613 - protein, 11 aa, Unknown
  Description of Unknown: mammalian sequence
IKRFGVEDGSV

SEQ ID NO: 208614 - protein, 4 aa, Unknown
  Description of Unknown: mammalian sequence
AYRW

SEQ ID NO: 208615 - protein, 4 aa, Unknown
  Description of Unknown: mammalian sequence
EDAL

SEQ ID NO: 208616 - protein, 7 aa, Unknown
  Description of Unknown: mammalian sequence
IRTVGEA

SEQ ID NO: 208617 - protein, 15 aa, Unknown
  Description of Unknown: mammalian sequence
ETGLNAYLPGLAGKE

SEQ ID NO: 208618 - protein, 9 aa, Unknown
  Description of Unknown: mammalian sequence
LEGRIKGKE

SEQ ID NO: 208619 - protein, 5 aa, Unknown
  Description of Unknown: mammalian sequence
RMRNF

SEQ ID NO: 208620 - protein, 6 aa, Unknown
  Description of Unknown: mammalian sequence
RGVLPE

SEQ ID NO: 208621 - protein, 6 aa, Unknown
  Description of Unknown: mammalian sequence
SLEEQR

SEQ ID NO: 208622 - protein, 7 aa, Unknown
  Description of Unknown: mammalian sequence
ANQLQNY

SEQ ID NO: 208623 - protein, 7 aa, Unknown
  Description of Unknown: mammalian sequence
NYLLPAG

SEQ ID NO: 208624 - protein, 14 aa, Unknown
  Description of Unknown: mammalian sequence
LDWQPRENPFQNLK

SEQ ID NO: 208625 - protein, 4 aa, Unknown
  Description of Unknown: mammalian sequence
RIQM

SEQ ID NO: 208626 - protein, 4 aa, Unknown
  Description of Unknown: mammalian sequence
WTDP

SEQ ID NO: 208627 - protein, 5 aa, Unknown
  Description of Unknown: mammalian sequence
ELGLL

SEQ ID NO: 208628 - protein, 7 aa, Unknown
  Description of Unknown: mammalian sequence
APSHGQI

SEQ ID NO: 208629 - protein, 8 aa, Unknown
  Description of Unknown: mammalian sequence
ATGMVDER

SEQ ID NO: 208630 - protein, 5 aa, Unknown
  Description of Unknown: mammalian sequence
FSLDE

SEQ ID NO: 208631 - protein, 6 aa, Unknown
  Description of Unknown: mammalian sequence
HWKLEA

SEQ ID NO: 208632 - protein, 4 aa, Unknown
  Description of Unknown: mammalian sequence
SEIG

SEQ ID NO: 208633 - protein, 8 aa, Unknown
  Description of Unknown: mammalian sequence
KGIGHSRF

SEQ ID NO: 208634 - protein, 5 aa, Unknown
  Description of Unknown: mammalian sequence
EGIKD

SEQ ID NO: 208635 - protein, 7 aa, Unknown
  Description of Unknown: mammalian sequence
LSRFPTP

SEQ ID NO: 208636 - protein, 15 aa, Unknown
  Description of Unknown: mammalian sequence
LLSPYHHVSGYSPRY

SEQ ID NO: 208637 - protein, 4 aa, Unknown
  Description of Unknown: mammalian sequence
PGDW

SEQ ID NO: 208638 - protein, 6 aa, Unknown
  Description of Unknown: mammalian sequence
DINKNE

SEQ ID NO: 208639 - protein, 6 aa, Unknown
  Description of Unknown: mammalian sequence
ITPYAE

SEQ ID NO: 208640 - protein, 7 aa, Unknown
  Description of Unknown: mammalian sequence
EFQSIGD

SEQ ID NO: 208641 - protein, 7 aa, Unknown
  Description of Unknown: mammalian sequence
KDPEGNV

SEQ ID NO: 208642 - protein, 7 aa, Unknown
  Description of Unknown: mammalian sequence
SLSVIGE

SEQ ID NO: 208643 - protein, 7 aa, Unknown
  Description of Unknown: mammalian sequence
SPVNSKR

SEQ ID NO: 208644 - protein, 8 aa, Unknown
  Description of Unknown: mammalian sequence
ENTRGFHG

SEQ ID NO: 208645 - protein, 8 aa, Unknown
  Description of Unknown: mammalian sequence
NNLKRDYT

SEQ ID NO: 208646 - protein, 10 aa, Unknown
  Description of Unknown: mammalian sequence
KYEDFRSPSA

SEQ ID NO: 208647 - protein, 24 aa, Unknown
  Description of Unknown: mammalian sequence
YPRLTNKIPKPPQEVKPHPYGVDR

SEQ ID NO: 208648 - protein, 7 aa, Unknown
  Description of Unknown: mammalian sequence
ARDRSYE

SEQ ID NO: 208649 - protein, 13 aa, Unknown
  Description of Unknown: mammalian sequence
VTSTVKNDIYAHI

SEQ ID NO: 208650 - protein, 22 aa, Unknown
  Description of Unknown: mammalian sequence
PYSERYGYRPALIPRPVMAGTL

SEQ ID NO: 208651 - protein, 5 aa, Unknown
  Description of Unknown: mammalian sequence
VSQPG

SEQ ID NO: 208652 - protein, 6 aa, Unknown
  Description of Unknown: mammalian sequence
LEGLPY

SEQ ID NO: 208653 - protein, 4 aa, Unknown
  Description of Unknown: mammalian sequence
QPGV

SEQ ID NO: 208654 - protein, 5 aa, Unknown
  Description of Unknown: mammalian sequence
WKLEG

SEQ ID NO: 208655 - protein, 6 aa, Unknown
  Description of Unknown: mammalian sequence
TAYNAP

SEQ ID NO: 208656 - protein, 11 aa, Unknown
  Description of Unknown: mammalian sequence
HKHDLSETNVY

SEQ ID NO: 208657 - protein, 7 aa, Unknown
  Description of Unknown: mammalian sequence
VLQAVTD

SEQ ID NO: 208658 - protein, 4 aa, Unknown
  Description of Unknown: mammalian sequence
YKDK

SEQ ID NO: 208659 - protein, 6 aa, Unknown
  Description of Unknown: mammalian sequence
NLPFNM

SEQ ID NO: 208660 - protein, 6 aa, Unknown
  Description of Unknown: mammalian sequence
WGVKDP

SEQ ID NO: 208661 - protein, 13 aa, Unknown
  Description of Unknown: mammalian sequence
QKKKYGDKVPENL

SEQ ID NO: 208662 - protein, 14 aa, Unknown
  Description of Unknown: mammalian sequence
NDLVEFNRFTNSPL

SEQ ID NO: 208663 - protein, 10 aa, Unknown
  Description of Unknown: mammalian sequence
LKEQESPVKV

SEQ ID NO: 208664 - protein, 6 aa, Unknown
  Description of Unknown: mammalian sequence
EEGIAN

SEQ ID NO: 208665 - protein, 11 aa, Unknown
  Description of Unknown: mammalian sequence
ADFQGAGRRFD

SEQ ID NO: 208666 - protein, 6 aa, Unknown
  Description of Unknown: mammalian sequence
AAGLPR

SEQ ID NO: 208667 - protein, 10 aa, Unknown
  Description of Unknown: mammalian sequence
TFTGLPHRFE

SEQ ID NO: 208668 - protein, 4 aa, Unknown
  Description of Unknown: mammalian sequence
TTVD

SEQ ID NO: 208669 - protein, 4 aa, Unknown
  Description of Unknown: mammalian sequence
DNLR

SEQ ID NO: 208670 - protein, 5 aa, Unknown
  Description of Unknown: mammalian sequence
FYHEP

SEQ ID NO: 208671 - protein, 6 aa, Unknown
  Description of Unknown: mammalian sequence
ALGYPL

SEQ ID NO: 208672 - protein, 6 aa, Unknown
  Description of Unknown: mammalian sequence
LLGEIS

SEQ ID NO: 208673 - protein, 6 aa, Unknown
  Description of Unknown: mammalian sequence
MGTVGN

SEQ ID NO: 208674 - protein, 6 aa, Unknown
  Description of Unknown: mammalian sequence
TGTNGK

SEQ ID NO: 208675 - protein, 10 aa, Unknown
  Description of Unknown: mammalian sequence
RLQPVCGRME

SEQ ID NO: 208676 - protein, 12 aa, Unknown
  Description of Unknown: mammalian sequence
TSEAHEKPEEKR

SEQ ID NO: 208677 - protein, 16 aa, Unknown
  Description of Unknown: mammalian sequence
NFGGYFPNKLAEYHDF

SEQ ID NO: 208678 - protein, 15 aa, Unknown
  Description of Unknown: mammalian sequence
RFAPPTWERIYPLDL

SEQ ID NO: 208679 - protein, 4 aa, Unknown
  Description of Unknown: mammalian sequence
VFQP

SEQ ID NO: 208680 - protein, 13 aa, Unknown
  Description of Unknown: mammalian sequence
EKASPAFYPQGQE

SEQ ID NO: 208681 - protein, 35 aa, Unknown
  Description of Unknown: mammalian sequence
SMAVRFAKVPPDAAKAFIADRSMLFNGGTASRPPV

SEQ ID NO: 208682 - protein, 4 aa, Unknown
  Description of Unknown: mammalian sequence
VLKL

SEQ ID NO: 208683 - protein, 6 aa, Unknown
  Description of Unknown: mammalian sequence
DLKNSK

SEQ ID NO: 208684 - protein, 9 aa, Unknown
  Description of Unknown: mammalian sequence
LKKDFQGVE

SEQ ID NO: 208685 - protein, 4 aa, Unknown
  Description of Unknown: mammalian sequence
GYTG

SEQ ID NO: 208686 - protein, 4 aa, Unknown
  Description of Unknown: mammalian sequence
PMSD

SEQ ID NO: 208687 - protein, 4 aa, Unknown
  Description of Unknown: mammalian sequence
SDPE

SEQ ID NO: 208688 - protein, 5 aa, Unknown
  Description of Unknown: mammalian sequence
DAPGQ

SEQ ID NO: 208689 - protein, 5 aa, Unknown
  Description of Unknown: mammalian sequence
FEQTL

SEQ ID NO: 208690 - protein, 5 aa, Unknown
  Description of Unknown: mammalian sequence
GGLSQ

SEQ ID NO: 208691 - protein, 6 aa, Unknown
  Description of Unknown: mammalian sequence
AGENEI

SEQ ID NO: 208692 - protein, 6 aa, Unknown
  Description of Unknown: mammalian sequence
QRCGFV

SEQ ID NO: 208693 - protein, 6 aa, Unknown
  Description of Unknown: mammalian sequence
RQREGT

SEQ ID NO: 208694 - protein, 7 aa, Unknown
  Description of Unknown: mammalian sequence
HGNNPLA

SEQ ID NO: 208695 - protein, 8 aa, Unknown
  Description of Unknown: mammalian sequence
GAHYRTSP

SEQ ID NO: 208696 - protein, 8 aa, Unknown
  Description of Unknown: mammalian sequence
QYTQDLDY

SEQ ID NO: 208697 - protein, 11 aa, Unknown
  Description of Unknown: mammalian sequence
WAGFRRPRGNL

SEQ ID NO: 208698 - protein, 13 aa, Unknown
  Description of Unknown: mammalian sequence
MGNHREASSGCYT

SEQ ID NO: 208699 - protein, 17 aa, Unknown
  Description of Unknown: mammalian sequence
LVFDDENFTHTPQGNIV

SEQ ID NO: 208700 - protein, 6 aa, Unknown
  Description of Unknown: mammalian sequence
ALPGFQ

SEQ ID NO: 208701 - protein, 14 aa, Unknown
  Description of Unknown: mammalian sequence
RASSVAERHVSPDT

SEQ ID NO: 208702 - protein, 7 aa, Unknown
  Description of Unknown: mammalian sequence
KISSGDW

SEQ ID NO: 208703 - protein, 7 aa, Unknown
  Description of Unknown: mammalian sequence
SKSKNPI

SEQ ID NO: 208704 - protein, 11 aa, Unknown
  Description of Unknown: mammalian sequence
FMNKDGCAGFT

SEQ ID NO: 208705 - protein, 4 aa, Unknown
  Description of Unknown: mammalian sequence
IMGS

SEQ ID NO: 208706 - protein, 4 aa, Unknown
  Description of Unknown: mammalian sequence
KPYK

SEQ ID NO: 208707 - protein, 5 aa, Unknown
  Description of Unknown: mammalian sequence
EGPPM

SEQ ID NO: 208708 - protein, 5 aa, Unknown
  Description of Unknown: mammalian sequence
LGAEI

SEQ ID NO: 208709 - protein, 5 aa, Unknown
  Description of Unknown: mammalian sequence
YIPEK

SEQ ID NO: 208710 - protein, 6 aa, Unknown
  Description of Unknown: mammalian sequence
GEKLNI

SEQ ID NO: 208711 - protein, 6 aa, Unknown
  Description of Unknown: mammalian sequence
NKGYHI

SEQ ID NO: 208712 - protein, 7 aa, Unknown
  Description of Unknown: mammalian sequence
CIETGEI

SEQ ID NO: 208713 - protein, 11 aa, Unknown
  Description of Unknown: mammalian sequence
TGNPLLWSDDL

SEQ ID NO: 208714 - protein, 8 aa, Unknown
  Description of Unknown: mammalian sequence
KHEYQDRF

SEQ ID NO: 208715 - protein, 9 aa, Unknown
  Description of Unknown: mammalian sequence
CRFGYRDSI

SEQ ID NO: 208716 - protein, 9 aa, Unknown
  Description of Unknown: mammalian sequence
RLDPTTVTP

SEQ ID NO: 208717 - protein, 11 aa, Unknown
  Description of Unknown: mammalian sequence
PKEWQPVLTYG

SEQ ID NO: 208718 - protein, 19 aa, Unknown
  Description of Unknown: mammalian sequence
CNTTKCNEGPILELENLPQ

SEQ ID NO: 208719 - protein, 24 aa, Unknown
  Description of Unknown: mammalian sequence
CGLDLCNQGNSGRAVTYSRSRYLE

SEQ ID NO: 208720 - protein, 7 aa, Unknown
  Description of Unknown: mammalian sequence
SFPKDPE

SEQ ID NO: 208721 - protein, 8 aa, Unknown
  Description of Unknown: mammalian sequence
VRTEIAKK

SEQ ID NO: 208722 - protein, 14 aa, Unknown
  Description of Unknown: mammalian sequence
IIRKDQRLKFGEGI

SEQ ID NO: 208723 - protein, 11 aa, Unknown
  Description of Unknown: mammalian sequence
EQLLGTSFLTR

SEQ ID NO: 208724 - protein, 25 aa, Unknown
  Description of Unknown: mammalian sequence
PHDQCACGVLTSEKRAPDLQDLPWQ

SEQ ID NO: 208725 - protein, 8 aa, Unknown
  Description of Unknown: mammalian sequence
KVSGENHV

SEQ ID NO: 208726 - protein, 6 aa, Unknown
  Description of Unknown: mammalian sequence
NVAEDY

SEQ ID NO: 208727 - protein, 4 aa, Unknown
  Description of Unknown: mammalian sequence
IDWR

SEQ ID NO: 208728 - protein, 4 aa, Unknown
  Description of Unknown: mammalian sequence
RKGS

SEQ ID NO: 208729 - protein, 5 aa, Unknown
  Description of Unknown: mammalian sequence
LFKSP

SEQ ID NO: 208730 - protein, 8 aa, Unknown
  Description of Unknown: mammalian sequence
QNLTAPAT

SEQ ID NO: 208731 - protein, 6 aa, Unknown
  Description of Unknown: mammalian sequence
YAPRPR

SEQ ID NO: 208732 - protein, 7 aa, Unknown
  Description of Unknown: mammalian sequence
YGPDGQR

SEQ ID NO: 208733 - protein, 9 aa, Unknown
  Description of Unknown: mammalian sequence
VSQKTFPQL

SEQ ID NO: 208734 - protein, 17 aa, Unknown
  Description of Unknown: mammalian sequence
GVSDDDAFEVGLTCGGI

SEQ ID NO: 208735 - protein, 4 aa, Unknown
  Description of Unknown: mammalian sequence
FNDK

SEQ ID NO: 208736 - protein, 4 aa, Unknown
  Description of Unknown: mammalian sequence
HDRN

SEQ ID NO: 208737 - protein, 5 aa, Unknown
  Description of Unknown: mammalian sequence
KVKAD

SEQ ID NO: 208738 - protein, 6 aa, Unknown
  Description of Unknown: mammalian sequence
EAGISS

SEQ ID NO: 208739 - protein, 6 aa, Unknown
  Description of Unknown: mammalian sequence
IKASWA

SEQ ID NO: 208740 - protein, 6 aa, Unknown
  Description of Unknown: mammalian sequence
LTRGFA

SEQ ID NO: 208741 - protein, 7 aa, Unknown
  Description of Unknown: mammalian sequence
LNGRARA

SEQ ID NO: 208742 - protein, 7 aa, Unknown
  Description of Unknown: mammalian sequence
SLATFDS

SEQ ID NO: 208743 - protein, 8 aa, Unknown
  Description of Unknown: mammalian sequence
ALPEGHAK

SEQ ID NO: 208744 - protein, 8 aa, Unknown
  Description of Unknown: mammalian sequence
ATTGVEGL

SEQ ID NO: 208745 - protein, 8 aa, Unknown
  Description of Unknown: mammalian sequence
RPKSTEKL

SEQ ID NO: 208746 - protein, 9 aa, Unknown
  Description of Unknown: mammalian sequence
YTSRKKTHE

SEQ ID NO: 208747 - protein, 10 aa, Unknown
  Description of Unknown: mammalian sequence
ASPYHLGIND

SEQ ID NO: 208748 - protein, 10 aa, Unknown
  Description of Unknown: mammalian sequence
GLQDWNVTPE

SEQ ID NO: 208749 - protein, 10 aa, Unknown
  Description of Unknown: mammalian sequence
LDRKSGDYNQ

SEQ ID NO: 208750 - protein, 13 aa, Unknown
  Description of Unknown: mammalian sequence
LLDRDLNLNLPPV

SEQ ID NO: 208751 - protein, 13 aa, Unknown
  Description of Unknown: mammalian sequence
SEGLLPLDNHYHF

SEQ ID NO: 208752 - protein, 14 aa, Unknown
  Description of Unknown: mammalian sequence
ESPVDSEQRGENDL

SEQ ID NO: 208753 - protein, 15 aa, Unknown
  Description of Unknown: mammalian sequence
ALHDMNVELEEKTSH

SEQ ID NO: 208754 - protein, 15 aa, Unknown
  Description of Unknown: mammalian sequence
VDKAPYRFTHGWTYS

SEQ ID NO: 208755 - protein, 16 aa, Unknown
  Description of Unknown: mammalian sequence
HRGAHIYMNSWQSIDF

SEQ ID NO: 208756 - protein, 17 aa, Unknown
  Description of Unknown: mammalian sequence
RENGLVRSPGGFPGEDL

SEQ ID NO: 208757 - protein, 18 aa, Unknown
  Description of Unknown: mammalian sequence
VAGVGTRSSDGFQTSGDY

SEQ ID NO: 208758 - protein, 21 aa, Unknown
  Description of Unknown: mammalian sequence
EIHVEQKLPQKLSAKAKELPI

SEQ ID NO: 208759 - protein, 6 aa, Unknown
  Description of Unknown: mammalian sequence
RWQSFN

SEQ ID NO: 208760 - protein, 9 aa, Unknown
  Description of Unknown: mammalian sequence
SLTARPGFL

SEQ ID NO: 208761 - protein, 10 aa, Unknown
  Description of Unknown: mammalian sequence
LRIPFSEHLG

SEQ ID NO: 208762 - protein, 10 aa, Unknown
  Description of Unknown: mammalian sequence
VVGGQQGSLE

SEQ ID NO: 208763 - protein, 13 aa, Unknown
  Description of Unknown: mammalian sequence
DDFDKDTLNINFQ

SEQ ID NO: 208764 - protein, 13 aa, Unknown
  Description of Unknown: mammalian sequence
YGRESLQSKFTQA

SEQ ID NO: 208765 - protein, 18 aa, Unknown
  Description of Unknown: mammalian sequence
VEAPDLPQQEWAPTYEER

SEQ ID NO: 208766 - protein, 31 aa, Unknown
  Description of Unknown: mammalian sequence
IGCPGDTQGDTYLSKGDKRVNEDAVRGLKAE

SEQ ID NO: 208767 - protein, 20 aa, Unknown
  Description of Unknown: mammalian sequence
FQGYYLVSPSETFLERDVLK

SEQ ID NO: 208768 - RNA, 22 nt, Homo sapiens
uggaauguaaagaaguauguau

SEQ ID NO: 208769 - RNA, 22 nt, Homo sapiens
caaauucguaucuaggggaaua

SEQ ID NO: 208770 - RNA, 23 nt, Homo sapiens
uacccuguagauccgaauuugug

SEQ ID NO: 208771 - RNA, 22 nt, Homo sapiens
acagauucgauucuaggggaau

SEQ ID NO: 208772 - RNA, 23 nt, Homo sapiens
uacccuguagaaccgaauuugug

SEQ ID NO: 208773 - RNA, 22 nt, Homo sapiens
caggccauauugugcugccuca

SEQ ID NO: 208774 - RNA, 22 nt, Homo sapiens
uagcagcacauaaugguuugug

SEQ ID NO: 208775 - RNA, 22 nt, Homo sapiens
cgaaucauuauuugcugcucua

SEQ ID NO: 208776 - RNA, 22 nt, Homo sapiens
uagcagcacaucaugguuuaca

SEQ ID NO: 208777 - RNA, 22 nt, Homo sapiens
ccaguauuaacugugcugcuga

SEQ ID NO: 208778 - RNA, 22 nt, Homo sapiens
ccaauauuacugugcugcuuua

SEQ ID NO: 208779 - RNA, 22 nt, Homo sapiens
uagcagcacguaaauauuggcg

SEQ ID NO: 208780 - RNA, 22 nt, Homo sapiens
acugcagugaaggcacuuguag

SEQ ID NO: 208781 - RNA, 23 nt, Homo sapiens
caaagugcuuacagugcagguag

SEQ ID NO: 208782 - RNA, 23 nt, Homo sapiens
acugcccuaagugcuccuucugg

SEQ ID NO: 208783 - RNA, 23 nt, Homo sapiens
uaaggugcaucuagugcagauag

SEQ ID NO: 208784 - RNA, 22 nt, Homo sapiens
ugcccuaaaugccccuucuggc

SEQ ID NO: 208785 - RNA, 23 nt, Homo sapiens
uaaggugcaucuagugcaguuag

SEQ ID NO: 208786 - RNA, 23 nt, Homo sapiens
ugugcaaaucuaugcaaaacuga

SEQ ID NO: 208787 - RNA, 22 nt, Homo sapiens
aguuuugcauaguugcacuaca

SEQ ID NO: 208788 - RNA, 23 nt, Homo sapiens
aguuuugcagguuugcauccagc

SEQ ID NO: 208789 - RNA, 22 nt, Homo sapiens
aguuuugcagguuugcauuuca

SEQ ID NO: 208790 - RNA, 23 nt, Homo sapiens
ugugcaaauccaugcaaaacuga

SEQ ID NO: 208791 - RNA, 22 nt, Homo sapiens
acugcauuaugagcacuuaaag

SEQ ID NO: 208792 - RNA, 23 nt, Homo sapiens
uaaagugcuuauagugcagguag

SEQ ID NO: 208793 - RNA, 22 nt, Homo sapiens
acuguaguaugggcacuuccag

SEQ ID NO: 208794 - RNA, 23 nt, Homo sapiens
caaagugcucauagugcagguag

SEQ ID NO: 208795 - RNA, 21 nt, Homo sapiens
caacaccagucgaugggcugu

SEQ ID NO: 208796 - RNA, 22 nt, Homo sapiens
uagcuuaucagacugauguuga

SEQ ID NO: 208797 - RNA, 22 nt, Homo sapiens
aagcugccaguugaagaacugu

SEQ ID NO: 208798 - RNA, 22 nt, Homo sapiens
aguucuucaguggcaagcuuua

SEQ ID NO: 208799 - RNA, 21 nt, Homo sapiens
aucacauugccagggauuucc

SEQ ID NO: 208800 - RNA, 22 nt, Homo sapiens
gggguuccuggggaugggauuu

SEQ ID NO: 208801 - RNA, 21 nt, Homo sapiens
aucacauugccagggauuacc

SEQ ID NO: 208802 - RNA, 22 nt, Homo sapiens
uggguuccuggcaugcugauuu

SEQ ID NO: 208803 - RNA, 22 nt, Homo sapiens
aucacauugccagugauuaccc

SEQ ID NO: 208804 - RNA, 22 nt, Homo sapiens
ugccuacugagcugauaucagu

SEQ ID NO: 208805 - RNA, 22 nt, Homo sapiens
ugccuacugagcugaaacacag

SEQ ID NO: 208806 - RNA, 22 nt, Homo sapiens
uggcucaguucagcaggaacag

SEQ ID NO: 208807 - RNA, 22 nt, Homo sapiens
cauugcacuugucucggucuga

SEQ ID NO: 208808 - RNA, 21 nt, Homo sapiens
aggcggagacuugggcaauug

SEQ ID NO: 208809 - RNA, 22 nt, Homo sapiens
ccuauucuugguuacuugcacg

SEQ ID NO: 208810 - RNA, 22 nt, Homo sapiens
ccuauucuugauuacuuguuuc

SEQ ID NO: 208811 - RNA, 22 nt, Homo sapiens
uucaaguaauccaggauaggcu

SEQ ID NO: 208812 - RNA, 22 nt, Homo sapiens
ccuguucuccauuacuuggcuc

SEQ ID NO: 208813 - RNA, 21 nt, Homo sapiens
uucaaguaauucaggauaggu

SEQ ID NO: 208814 - RNA, 21 nt, Homo sapiens
uucacaguggcuaaguuccgc

SEQ ID NO: 208815 - RNA, 22 nt, Homo sapiens
agggcuuagcugcuugugagca

SEQ ID NO: 208816 - RNA, 21 nt, Homo sapiens
uucacaguggcuaaguucugc

SEQ ID NO: 208817 - RNA, 22 nt, Homo sapiens
agagcuuagcugauuggugaac

SEQ ID NO: 208818 - RNA, 22 nt, Homo sapiens
cacuagauugugagcuccugga

SEQ ID NO: 208819 - RNA, 22 nt, Homo sapiens
aaggagcucacagucuauugag

SEQ ID NO: 208820 - RNA, 22 nt, Homo sapiens
uagcaccaucugaaaucgguua

SEQ ID NO: 208821 - RNA, 22 nt, Homo sapiens
acugauuucuuuugguguucag

SEQ ID NO: 208822 - RNA, 24 nt, Homo sapiens
gcugguuucauauggugguuuaga

SEQ ID NO: 208823 - RNA, 22 nt, Homo sapiens
cugguuucacaugguggcuuag

SEQ ID NO: 208824 - RNA, 23 nt, Homo sapiens
uagcaccauuugaaaucaguguu

SEQ ID NO: 208825 - RNA, 22 nt, Homo sapiens
uagcaccauuugaaaucgguua

SEQ ID NO: 208826 - RNA, 22 nt, Homo sapiens
ugaccgauuucuccugguguuc

SEQ ID NO: 208827 - RNA, 22 nt, Homo sapiens
cuuucagucggauguuugcagc

SEQ ID NO: 208828 - RNA, 22 nt, Homo sapiens
uguaaacauccucgacuggaag

SEQ ID NO: 208829 - RNA, 22 nt, Homo sapiens
cugggagguggauguuuacuuc

SEQ ID NO: 208830 - RNA, 22 nt, Homo sapiens
uguaaacauccuacacucagcu

SEQ ID NO: 208831 - RNA, 22 nt, Homo sapiens
cugggagaggguuguuuacucc

SEQ ID NO: 208832 - RNA, 22 nt, Homo sapiens
cugggagaaggcuguuuacucu

SEQ ID NO: 208833 - RNA, 23 nt, Homo sapiens
uguaaacauccuacacucucagc

SEQ ID NO: 208834 - RNA, 22 nt, Homo sapiens
cuuucagucagauguuugcugc

SEQ ID NO: 208835 - RNA, 22 nt, Homo sapiens
uguaaacauccccgacuggaag

SEQ ID NO: 208836 - RNA, 22 nt, Homo sapiens
cuuucagucggauguuuacagc

SEQ ID NO: 208837 - RNA, 22 nt, Homo sapiens
uguaaacauccuugacuggaag

SEQ ID NO: 208838 - RNA, 22 nt, Homo sapiens
ugcuaugccaacauauugccau

SEQ ID NO: 208839 - RNA, 21 nt, Homo sapiens
aggcaagaugcuggcauagcu

SEQ ID NO: 208840 - RNA, 22 nt, Homo sapiens
caauuuagugugugugauauuu

SEQ ID NO: 208841 - RNA, 22 nt, Homo sapiens
uauugcacauuacuaaguugca

SEQ ID NO: 208842 - RNA, 22 nt, Homo sapiens
caaucagcaaguauacugcccu

SEQ ID NO: 208843 - RNA, 22 nt, Homo sapiens
uggcagugucuuagcugguugu

SEQ ID NO: 208844 - RNA, 22 nt, Homo sapiens
caaucacuaacuccacugccau

SEQ ID NO: 208845 - RNA, 23 nt, Homo sapiens
uaggcagugucauuagcugauug

SEQ ID NO: 208846 - RNA, 22 nt, Homo sapiens
aaucacuaaccacacggccagg

SEQ ID NO: 208847 - RNA, 23 nt, Homo sapiens
aggcaguguaguuagcugauugc

SEQ ID NO: 208848 - RNA, 22 nt, Homo sapiens
caacaaaucacagucugccaua

SEQ ID NO: 208849 - RNA, 22 nt, Homo sapiens
caacaaaucccagucuaccuaa

SEQ ID NO: 208850 - RNA, 23 nt, Homo sapiens
uggaagacuagugauuuuguugu

SEQ ID NO: 208851 - RNA, 23 nt, Homo sapiens
agguugggaucgguugcaaugcu

SEQ ID NO: 208852 - RNA, 22 nt, Homo sapiens
ggguggggauuuguugcauuac

SEQ ID NO: 208853 - RNA, 22 nt, Homo sapiens
uauugcacuugucccggccugu

SEQ ID NO: 208854 - RNA, 22 nt, Homo sapiens
uauugcacucgucccggccucc

SEQ ID NO: 208855 - RNA, 22 nt, Homo sapiens
agggacgggacgcggugcagug

SEQ ID NO: 208856 - RNA, 22 nt, Homo sapiens
acugcugagcuagcacuucccg

SEQ ID NO: 208857 - RNA, 23 nt, Homo sapiens
caaagugcuguucgugcagguag

SEQ ID NO: 208858 - RNA, 22 nt, Homo sapiens
auaaagcuagauaaccgaaagu

SEQ ID NO: 208859 - RNA, 22 nt, Homo sapiens
uucaacggguauuuauugagca

SEQ ID NO: 208860 - RNA, 23 nt, Homo sapiens
ucuuugguuaucuagcuguauga

SEQ ID NO: 208861 - RNA, 22 nt, Homo sapiens
aaucaugugcagugccaauaug

SEQ ID NO: 208862 - RNA, 23 nt, Homo sapiens
uuuggcacuagcacauuuuugcu

SEQ ID NO: 208863 - RNA, 22 nt, Homo sapiens
cuauacaacuuacuacuuuccc

SEQ ID NO: 208864 - RNA, 22 nt, Homo sapiens
ugagguaguaaguuguauuguu

SEQ ID NO: 208865 - RNA, 22 nt, Homo sapiens
caagcucgcuucuaugggucug

SEQ ID NO: 208866 - RNA, 22 nt, Homo sapiens
aacccguagauccgaucuugug

SEQ ID NO: 208867 - RNA, 22 nt, Homo sapiens
caagcucgugucuguggguccg

SEQ ID NO: 208868 - RNA, 22 nt, Homo sapiens
cacccguagaaccgaccuugcg

SEQ ID NO: 208869 - RNA, 22 nt, Homo sapiens
caagcuuguaucuauagguaug

SEQ ID NO: 208870 - RNA, 22 nt, Homo sapiens
aacccguagauccgaacuugug

SEQ ID NO: 208871 - RNA, 21 nt, Homo sapiens
uacaguacugugauaacugaa

SEQ ID NO: 208872 - RNA, 22 nt, Homo sapiens
caguuaucacagugcugaugcu

SEQ ID NO: 208873 - RNA, 23 nt, Homo sapiens
agcuucuuuacagugcugccuug

SEQ ID NO: 208874 - RNA, 23 nt, Homo sapiens
agcagcauuguacagggcuauga

SEQ ID NO: 208875 - RNA, 23 nt, Homo sapiens
ucauagcccuguacaaugcugcu

SEQ ID NO: 208876 - RNA, 22 nt, Homo sapiens
acggauguuugagcaugugcua

SEQ ID NO: 208877 - RNA, 23 nt, Homo sapiens
ucaaaugcucagacuccuguggu

SEQ ID NO: 208878 - RNA, 22 nt, Homo sapiens
cugcaauguaagcacuucuuac

SEQ ID NO: 208879 - RNA, 23 nt, Homo sapiens
aaaagugcuuacagugcagguag

SEQ ID NO: 208880 - RNA, 22 nt, Homo sapiens
ccgcacuguggguacuugcugc

SEQ ID NO: 208881 - RNA, 21 nt, Homo sapiens
uaaagugcugacagugcagau

SEQ ID NO: 208882 - RNA, 23 nt, Homo sapiens
agcagcauuguacagggcuauca

SEQ ID NO: 208883 - RNA, 22 nt, Homo sapiens
aacgccauuaucacacuaaaua

SEQ ID NO: 208884 - RNA, 22 nt, Homo sapiens
uggagugugacaaugguguuug

SEQ ID NO: 208885 - RNA, 20 nt, Homo sapiens
uaaggcacgcggugaaugcc

SEQ ID NO: 208886 - RNA, 22 nt, Homo sapiens
cguguucacagcggaccuugau

SEQ ID NO: 208887 - RNA, 22 nt, Homo sapiens
acaggugagguucuugggagcc

SEQ ID NO: 208888 - RNA, 24 nt, Homo sapiens
ucccugagacccuuuaaccuguga

SEQ ID NO: 208889 - RNA, 22 nt, Homo sapiens
acggguuaggcucuugggagcu

SEQ ID NO: 208890 - RNA, 22 nt, Homo sapiens
ucacaagucaggcucuugggac

SEQ ID NO: 208891 - RNA, 22 nt, Homo sapiens
ucccugagacccuaacuuguga

SEQ ID NO: 208892 - RNA, 22 nt, Homo sapiens
ucguaccgugaguaauaaugcg

SEQ ID NO: 208893 - RNA, 21 nt, Homo sapiens
cauuauuacuuuugguacgcg

SEQ ID NO: 208894 - RNA, 22 nt, Homo sapiens
ucggauccgucugagcuuggcu

SEQ ID NO: 208895 - RNA, 22 nt, Homo sapiens
cugaagcucagagggcucugau

SEQ ID NO: 208896 - RNA, 21 nt, Homo sapiens
ucacagugaaccggucucuuu

SEQ ID NO: 208897 - RNA, 22 nt, Homo sapiens
aagcccuuaccccaaaaaguau

SEQ ID NO: 208898 - RNA, 22 nt, Homo sapiens
aagcccuuaccccaaaaagcau

SEQ ID NO: 208899 - RNA, 21 nt, Homo sapiens
cuuuuugcggucugggcuugc

SEQ ID NO: 208900 - RNA, 22 nt, Homo sapiens
cagugcaauguuaaaagggcau

SEQ ID NO: 208901 - RNA, 22 nt, Homo sapiens
uucacauugugcuacugucugc

SEQ ID NO: 208902 - RNA, 22 nt, Homo sapiens
cagugcaaugaugaaagggcau

SEQ ID NO: 208903 - RNA, 21 nt, Homo sapiens
acucuuucccuguugcacuac

SEQ ID NO: 208904 - RNA, 22 nt, Homo sapiens
uaacagucuacagccauggucg

SEQ ID NO: 208905 - RNA, 22 nt, Homo sapiens
accguggcuuucgauuguuacu

SEQ ID NO: 208906 - RNA, 22 nt, Homo sapiens
uuugguccccuucaaccagcug

SEQ ID NO: 208907 - RNA, 22 nt, Homo sapiens
uuugguccccuucaaccagcua

SEQ ID NO: 208908 - RNA, 22 nt, Homo sapiens
ugugacugguugaccagagggg

SEQ ID NO: 208909 - RNA, 22 nt, Homo sapiens
uauagggauuggagccguggcg

SEQ ID NO: 208910 - RNA, 23 nt, Homo sapiens
uauggcuuuuuauuccuauguga

SEQ ID NO: 208911 - RNA, 22 nt, Homo sapiens
auguagggcuaaaagccauggg

SEQ ID NO: 208912 - RNA, 23 nt, Homo sapiens
uauggcuuuucauuccuauguga

SEQ ID NO: 208913 - RNA, 22 nt, Homo sapiens
caucaucgucucaaaugagucu

SEQ ID NO: 208914 - RNA, 23 nt, Homo sapiens
acuccauuuguuuugaugaugga

SEQ ID NO: 208915 - RNA, 23 nt, Homo sapiens
uuauugcuuaagaauacgcguag

SEQ ID NO: 208916 - RNA, 22 nt, Homo sapiens
gcuacuucacaacaccagggcc

SEQ ID NO: 208917 - RNA, 22 nt, Homo sapiens
gcuauuucacgacaccaggguu

SEQ ID NO: 208918 - RNA, 23 nt, Homo sapiens
agcugguguugugaaucaggccg

SEQ ID NO: 208919 - RNA, 23 nt, Homo sapiens
uggagacgcggcccuguuggagu

SEQ ID NO: 208920 - RNA, 23 nt, Homo sapiens
ucuacagugcacgugucuccagu

SEQ ID NO: 208921 - RNA, 21 nt, Homo sapiens
uaccacaggguagaaccacgg

SEQ ID NO: 208922 - RNA, 22 nt, Homo sapiens
cagugguuuuacccuaugguag

SEQ ID NO: 208923 - RNA, 22 nt, Homo sapiens
uaacacugucugguaaagaugg

SEQ ID NO: 208924 - RNA, 22 nt, Homo sapiens
caucuuccaguacaguguugga

SEQ ID NO: 208925 - RNA, 23 nt, Homo sapiens
uguaguguuuccuacuuuaugga

SEQ ID NO: 208926 - RNA, 21 nt, Homo sapiens
cauaaaguagaaagcacuacu

SEQ ID NO: 208927 - RNA, 21 nt, Homo sapiens
ugagaugaagcacuguagcuc

SEQ ID NO: 208928 - RNA, 22 nt, Homo sapiens
ggugcagugcugcaucucuggu

SEQ ID NO: 208929 - RNA, 20 nt, Homo sapiens
uacaguauagaugauguacu

SEQ ID NO: 208930 - RNA, 22 nt, Homo sapiens
ggauaucaucauauacuguaag

SEQ ID NO: 208931 - RNA, 22 nt, Homo sapiens
ggauuccuggaaauacuguucu

SEQ ID NO: 208932 - RNA, 23 nt, Homo sapiens
guccaguuuucccaggaaucccu

SEQ ID NO: 208933 - RNA, 22 nt, Homo sapiens
ccucugaaauucaguucuucag

SEQ ID NO: 208934 - RNA, 22 nt, Homo sapiens
ugagaacugaauuccauggguu

SEQ ID NO: 208935 - RNA, 22 nt, Homo sapiens
ugcccuguggacucaguucugg

SEQ ID NO: 208936 - RNA, 22 nt, Homo sapiens
ugagaacugaauuccauaggcu

SEQ ID NO: 208937 - RNA, 20 nt, Homo sapiens
guguguggaaaugcuucugc

SEQ ID NO: 208938 - RNA, 22 nt, Homo sapiens
gugugcggaaaugcuucugcua

SEQ ID NO: 208939 - RNA, 22 nt, Homo sapiens
ucagugcacuacagaacuuugu

SEQ ID NO: 208940 - RNA, 22 nt, Homo sapiens
aaaguucugagacacuccgacu

SEQ ID NO: 208941 - RNA, 22 nt, Homo sapiens
ucagugcaucacagaacuuugu

SEQ ID NO: 208942 - RNA, 22 nt, Homo sapiens
aaguucuguuauacacucaggc

SEQ ID NO: 208943 - RNA, 21 nt, Homo sapiens
agggagggacgggggcugugc

SEQ ID NO: 208944 - RNA, 23 nt, Homo sapiens
ucuggcuccgugucuucacuccc

SEQ ID NO: 208945 - RNA, 22 nt, Homo sapiens
cugguacaggccugggggacag

SEQ ID NO: 208946 - RNA, 22 nt, Homo sapiens
ucucccaacccuuguaccagug

SEQ ID NO: 208947 - RNA, 21 nt, Homo sapiens
cuagacugaagcuccuugagg

SEQ ID NO: 208948 - RNA, 21 nt, Homo sapiens
ucgaggagcucacagucuagu

SEQ ID NO: 208949 - RNA, 18 nt, Homo sapiens
ucgaggagcucacagucu

SEQ ID NO: 208950 - RNA, 21 nt, Homo sapiens
ucagugcaugacagaacuugg

SEQ ID NO: 208951 - RNA, 22 nt, Homo sapiens
uugcauagucacaaaagugauc

SEQ ID NO: 208952 - RNA, 22 nt, Homo sapiens
aaucauacacgguugaccuauu

SEQ ID NO: 208953 - RNA, 22 nt, Homo sapiens
uagguuauccguguugccuucg

SEQ ID NO: 208954 - RNA, 22 nt, Homo sapiens
cuccuacauauuagcauuaaca

SEQ ID NO: 208955 - RNA, 23 nt, Homo sapiens
uuaaugcuaaucgugauaggggu

SEQ ID NO: 208956 - RNA, 22 nt, Homo sapiens
accacugaccguugacuguacc

SEQ ID NO: 208957 - RNA, 22 nt, Homo sapiens
accaucgaccguugauuguacc

SEQ ID NO: 208958 - RNA, 23 nt, Homo sapiens
aacauucaacgcugucggugagu

SEQ ID NO: 208959 - RNA, 21 nt, Homo sapiens
cucacugaacaaugaaugcaa

SEQ ID NO: 208960 - RNA, 23 nt, Homo sapiens
aacauucauugcugucggugggu

SEQ ID NO: 208961 - RNA, 22 nt, Homo sapiens
aaccaucgaccguugaguggac

SEQ ID NO: 208962 - RNA, 22 nt, Homo sapiens
aacauucaaccugucggugagu

SEQ ID NO: 208963 - RNA, 23 nt, Homo sapiens
aacauucauuguugucggugggu

SEQ ID NO: 208964 - RNA, 21 nt, Homo sapiens
ugguucuagacuugccaacua

SEQ ID NO: 208965 - RNA, 24 nt, Homo sapiens
uuuggcaaugguagaacucacacu

SEQ ID NO: 208966 - RNA, 22 nt, Homo sapiens
gugaauuaccgaagggccauaa

SEQ ID NO: 208967 - RNA, 22 nt, Homo sapiens
uauggcacugguagaauucacu

SEQ ID NO: 208968 - RNA, 22 nt, Homo sapiens
uggacggagaacugauaagggu

SEQ ID NO: 208969 - RNA, 22 nt, Homo sapiens
aggggcuggcuuuccucugguc

SEQ ID NO: 208970 - RNA, 22 nt, Homo sapiens
uggagagaaaggcaguuccuga

SEQ ID NO: 208971 - RNA, 22 nt, Homo sapiens
gcccaaaggugaauuuuuuggg

SEQ ID NO: 208972 - RNA, 22 nt, Homo sapiens
caaagaauucuccuuuugggcu

SEQ ID NO: 208973 - RNA, 22 nt, Homo sapiens
ucgugucuuguguugcagccgg

SEQ ID NO: 208974 - RNA, 22 nt, Homo sapiens
ggcuacaacacaggacccgggc

SEQ ID NO: 208975 - RNA, 21 nt, Homo sapiens
cucccacaugcaggguuugca

SEQ ID NO: 208976 - RNA, 21 nt, Homo sapiens
caucccuugcaugguggaggg

SEQ ID NO: 208977 - RNA, 22 nt, Homo sapiens
ugauauguuugauauauuaggu

SEQ ID NO: 208978 - RNA, 21 nt, Homo sapiens
ugauauguuugauauuggguu

SEQ ID NO: 208979 - RNA, 22 nt, Homo sapiens
gcugcgcuuggauuucgucccc

SEQ ID NO: 208980 - RNA, 23 nt, Homo sapiens
caacggaaucccaaaagcagcug

SEQ ID NO: 208981 - RNA, 22 nt, Homo sapiens
cugccaauuccauaggucacag

SEQ ID NO: 208982 - RNA, 21 nt, Homo sapiens
cugaccuaugaauugacagcc

SEQ ID NO: 208983 - RNA, 22 nt, Homo sapiens
aacuggccuacaaagucccagu

SEQ ID NO: 208984 - RNA, 22 nt, Homo sapiens
ugggucuuugcgggcgagauga

SEQ ID NO: 208985 - RNA, 22 nt, Homo sapiens
aacuggcccucaaagucccgcu

SEQ ID NO: 208986 - RNA, 22 nt, Homo sapiens
cgggguuuugagggcgagauga

SEQ ID NO: 208987 - RNA, 22 nt, Homo sapiens
ccaguggggcugcuguuaucug

SEQ ID NO: 208988 - RNA, 22 nt, Homo sapiens
uguaacagcaacuccaugugga

SEQ ID NO: 208989 - RNA, 22 nt, Homo sapiens
ccaauauuggcugugcugcucc

SEQ ID NO: 208990 - RNA, 21 nt, Homo sapiens
uagcagcacagaaauauuggc

SEQ ID NO: 208991 - RNA, 22 nt, Homo sapiens
cggcaacaagaaacugccugag

SEQ ID NO: 208992 - RNA, 22 nt, Homo sapiens
uagguaguuucauguuguuggg

SEQ ID NO: 208993 - RNA, 22 nt, Homo sapiens
ucgacagcacgacacugccuuc

SEQ ID NO: 208994 - RNA, 22 nt, Homo sapiens
uagguaguuuccuguuguuggg

SEQ ID NO: 208995 - RNA, 22 nt, Homo sapiens
uucaccaccuucuccacccagc

SEQ ID NO: 208996 - RNA, 23 nt, Homo sapiens
cggguagagagggcagugggagg

SEQ ID NO: 208997 - RNA, 22 nt, Homo sapiens
gguccagaggggagauagguuc

SEQ ID NO: 208998 - RNA, 22 nt, Homo sapiens
acaguagucugcacauugguua

SEQ ID NO: 208999 - RNA, 23 nt, Homo sapiens
cccaguguucagacuaccuguuc

SEQ ID NO: 209000 - RNA, 22 nt, Homo sapiens
acaguagucugcacauugguua

SEQ ID NO: 209001 - RNA, 23 nt, Homo sapiens
cccaguguuuagacuaucuguuc

SEQ ID NO: 209002 - RNA, 22 nt, Homo sapiens
uaacacugucugguaacgaugu

SEQ ID NO: 209003 - RNA, 22 nt, Homo sapiens
caucuuaccggacagugcugga

SEQ ID NO: 209004 - RNA, 22 nt, Homo sapiens
uaauacugccugguaaugauga

SEQ ID NO: 209005 - RNA, 22 nt, Homo sapiens
caucuuacugggcagcauugga

SEQ ID NO: 209006 - RNA, 23 nt, Homo sapiens
uaauacugccggguaaugaugga

SEQ ID NO: 209007 - RNA, 22 nt, Homo sapiens
cgucuuacccagcaguguuugg

SEQ ID NO: 209008 - RNA, 20 nt, Homo sapiens
agagguauagggcaugggaa

SEQ ID NO: 209009 - RNA, 22 nt, Homo sapiens
uuccuaugcauauacuucuuug

SEQ ID NO: 209010 - RNA, 22 nt, Homo sapiens
gugaaauguuuaggaccacuag

SEQ ID NO: 209011 - RNA, 23 nt, Homo sapiens
uugaacuguuaagaaccacugga

SEQ ID NO: 209012 - RNA, 22 nt, Homo sapiens
uagugguccuaaacauuucaca

SEQ ID NO: 209013 - RNA, 21 nt, Homo sapiens
gcugggaaggcaaagggacgu

SEQ ID NO: 209014 - RNA, 22 nt, Homo sapiens
uucccuuugucauccuaugccu

SEQ ID NO: 209015 - RNA, 21 nt, Homo sapiens
gauuucaguggagugaaguuc

SEQ ID NO: 209016 - RNA, 22 nt, Homo sapiens
uccuucauuccaccggagucug

SEQ ID NO: 209017 - RNA, 22 nt, Homo sapiens
uggaauguaaggaagugugugg

SEQ ID NO: 209018 - RNA, 22 nt, Homo sapiens
auaagacgagcaaaaagcuugu

SEQ ID NO: 209019 - RNA, 22 nt, Homo sapiens
auaagacgaacaaaagguuugu

SEQ ID NO: 209020 - RNA, 22 nt, Homo sapiens
cugugcgugugacagcggcuga

SEQ ID NO: 209021 - RNA, 21 nt, Homo sapiens
gcagggacagcaaaggggugc

SEQ ID NO: 209022 - RNA, 22 nt, Homo sapiens
uucccuuugucauccuucgccu

SEQ ID NO: 209023 - RNA, 21 nt, Homo sapiens
uaacagucuccagucacggcc

SEQ ID NO: 209024 - RNA, 23 nt, Homo sapiens
accuuggcucuagacugcuuacu

SEQ ID NO: 209025 - RNA, 22 nt, Homo sapiens
acagcaggcacagacaggcagu

SEQ ID NO: 209026 - RNA, 22 nt, Homo sapiens
ugccugucuacacuugcugugc

SEQ ID NO: 209027 - RNA, 21 nt, Homo sapiens
augaccuaugaauugacagac

SEQ ID NO: 209028 - RNA, 22 nt, Homo sapiens
ucacaguggucucugggauuau

SEQ ID NO: 209029 - RNA, 22 nt, Homo sapiens
uaaucucagcuggcaacuguga

SEQ ID NO: 209030 - RNA, 22 nt, Homo sapiens
aaaucucugcaggcaaauguga

SEQ ID NO: 209031 - RNA, 23 nt, Homo sapiens
uacugcaucaggaacugauugga

SEQ ID NO: 209032 - RNA, 22 nt, Homo sapiens
augguuccgucaagcaccaugg

SEQ ID NO: 209033 - RNA, 22 nt, Homo sapiens
caugguucugucaagcaccgcg

SEQ ID NO: 209034 - RNA, 21 nt, Homo sapiens
uugugcuugaucuaaccaugu

SEQ ID NO: 209035 - RNA, 22 nt, Homo sapiens
agaguugagucuggacgucccg

SEQ ID NO: 209036 - RNA, 22 nt, Homo sapiens
agaauuguggcuggacaucugu

SEQ ID NO: 209037 - RNA, 21 nt, Homo sapiens
ugauuguccaaacgcaauucu

SEQ ID NO: 209038 - RNA, 23 nt, Homo sapiens
agcuacauugucugcuggguuuc

SEQ ID NO: 209039 - RNA, 22 nt, Homo sapiens
accuggcauacaauguagauuu

SEQ ID NO: 209040 - RNA, 21 nt, Homo sapiens
agcuacaucuggcuacugggu

SEQ ID NO: 209041 - RNA, 22 nt, Homo sapiens
cucaguagccaguguagauccu

SEQ ID NO: 209042 - RNA, 22 nt, Homo sapiens
ugucaguuugucaaauacccca

SEQ ID NO: 209043 - RNA, 22 nt, Homo sapiens
cguguauuugacaagcugaguu

SEQ ID NO: 209044 - RNA, 23 nt, Homo sapiens
aaaauggugcccuagugacuaca

SEQ ID NO: 209045 - RNA, 21 nt, Homo sapiens
caagucacuagugguuccguu

SEQ ID NO: 209046 - RNA, 22 nt, Homo sapiens
gaggguuggguggaggcucucc

SEQ ID NO: 209047 - RNA, 21 nt, Homo sapiens
agggcccccccucaauccugu

SEQ ID NO: 209048 - RNA, 21 nt, Homo sapiens
auguaugugugcaugugcaug

SEQ ID NO: 209049 - RNA, 24 nt, Homo sapiens
agcagaagcagggagguucuccca

SEQ ID NO: 209050 - RNA, 22 nt, Homo sapiens
uaugugggaugguaaaccgcuu

SEQ ID NO: 209051 - RNA, 22 nt, Homo sapiens
ugguuuaccgucccacauacau

SEQ ID NO: 209052 - RNA, 22 nt, Homo sapiens
uauacaagggcagacucucucu

SEQ ID NO: 209053 - RNA, 23 nt, Homo sapiens
cagugcaauaguauugucaaagc

SEQ ID NO: 209054 - RNA, 22 nt, Homo sapiens
gcucugacuuuauugcacuacu

SEQ ID NO: 209055 - RNA, 23 nt, Homo sapiens
cagugcaaugauauugucaaagc

SEQ ID NO: 209056 - RNA, 23 nt, Homo sapiens
uaagugcuuccauguuuugguga

SEQ ID NO: 209057 - RNA, 23 nt, Homo sapiens
acuuaaacguggauguacuugcu

SEQ ID NO: 209058 - RNA, 23 nt, Homo sapiens
uaagugcuuccauguuuuaguag

SEQ ID NO: 209059 - RNA, 22 nt, Homo sapiens
acuuuaacauggaagugcuuuc

SEQ ID NO: 209060 - RNA, 23 nt, Homo sapiens
uaagugcuuccauguuucagugg

SEQ ID NO: 209061 - RNA, 22 nt, Homo sapiens
uuuaacauggggguaccugcug

SEQ ID NO: 209062 - RNA, 23 nt, Homo sapiens
uaagugcuuccauguuugagugu

SEQ ID NO: 209063 - RNA, 22 nt, Homo sapiens
acuuuaacauggaggcacuugc

SEQ ID NO: 209064 - RNA, 17 nt, Homo sapiens
uaagugcuuccaugcuu

SEQ ID NO: 209065 - RNA, 17 nt, Homo sapiens
uaauugcuuccauguuu

SEQ ID NO: 209066 - RNA, 22 nt, Homo sapiens
aaaagcuggguugagagggcga

SEQ ID NO: 209067 - RNA, 22 nt, Homo sapiens
aaaagcuggguugagagggcaa

SEQ ID NO: 209068 - RNA, 20 nt, Homo sapiens
aaaagcuggguugagagggu

SEQ ID NO: 209069 - RNA, 19 nt, Homo sapiens
aaaagcuggguugagagga

SEQ ID NO: 209070 - RNA, 18 nt, Homo sapiens
aaagcuggguugagaagg

SEQ ID NO: 209071 - RNA, 21 nt, Homo sapiens
cacauuacacggucgaccucu

SEQ ID NO: 209072 - RNA, 22 nt, Homo sapiens
aggugguccguggcgcguucgc

SEQ ID NO: 209073 - RNA, 22 nt, Homo sapiens
cccaauacacggucgaccucuu

SEQ ID NO: 209074 - RNA, 23 nt, Homo sapiens
agguuguccguggugaguucgca

SEQ ID NO: 209075 - RNA, 20 nt, Homo sapiens
acugccccaggugcugcugg

SEQ ID NO: 209076 - RNA, 23 nt, Homo sapiens
cgcauccccuagggcauuggugu

SEQ ID NO: 209077 - RNA, 23 nt, Homo sapiens
ccuaguagguguccaguaagugu

SEQ ID NO: 209078 - RNA, 20 nt, Homo sapiens
ccucugggcccuuccuccag

SEQ ID NO: 209079 - RNA, 22 nt, Homo sapiens
cuggcccucucugcccuuccgu

SEQ ID NO: 209080 - RNA, 22 nt, Homo sapiens
aacacaccugguuaaccucuuu

SEQ ID NO: 209081 - RNA, 23 nt, Homo sapiens
gcaaagcacacggccugcagaga

SEQ ID NO: 209082 - RNA, 22 nt, Homo sapiens
ucucugggccugugucuuaggc

SEQ ID NO: 209083 - RNA, 21 nt, Homo sapiens
gccccugggccuauccuagaa

SEQ ID NO: 209084 - RNA, 22 nt, Homo sapiens
cuagguauggucccagggaucc

SEQ ID NO: 209085 - RNA, 22 nt, Homo sapiens
uuuuucauuauugcuccugacc

SEQ ID NO: 209086 - RNA, 23 nt, Homo sapiens
ucaagagcaauaacgaaaaaugu

SEQ ID NO: 209087 - RNA, 22 nt, Homo sapiens
cuccuauaugaugccuuucuuc

SEQ ID NO: 209088 - RNA, 21 nt, Homo sapiens
gaacggcuucauacaggaguu

SEQ ID NO: 209089 - RNA, 22 nt, Homo sapiens
uccagcaucagugauuuuguug

SEQ ID NO: 209090 - RNA, 22 nt, Homo sapiens
aacaauauccuggugcugagug

SEQ ID NO: 209091 - RNA, 23 nt, Homo sapiens
ugagcgccucgacgacagagccg

SEQ ID NO: 209092 - RNA, 23 nt, Homo sapiens
ucccuguccuccaggagcucacg

SEQ ID NO: 209093 - RNA, 22 nt, Homo sapiens
caauguuuccacagugcaucac

SEQ ID NO: 209094 - RNA, 21 nt, Homo sapiens
gugcauuguaguugcauugca

SEQ ID NO: 209095 - RNA, 22 nt, Homo sapiens
cagugccucggcagugcagccc

SEQ ID NO: 209096 - RNA, 20 nt, Homo sapiens
gugcauugcuguugcauugc

SEQ ID NO: 209097 - RNA, 22 nt, Homo sapiens
uccgucucaguuacuuuauagc

SEQ ID NO: 209098 - RNA, 22 nt, Homo sapiens
uuauaaagcaaugagacugauu

SEQ ID NO: 209099 - RNA, 23 nt, Homo sapiens
ucucacacagaaaucgcacccgu

SEQ ID NO: 209100 - RNA, 21 nt, Homo sapiens
aggggugcuaucugugauuga

SEQ ID NO: 209101 - RNA, 22 nt, Homo sapiens
gcccugaacgaggggucuggag

SEQ ID NO: 209102 - RNA, 22 nt, Homo sapiens
gcugacuccuaguccagggcuc

SEQ ID NO: 209103 - RNA, 23 nt, Homo sapiens
ugucugcccgcaugccugccucu

SEQ ID NO: 209104 - RNA, 23 nt, Homo sapiens
ucccccaggugugauucugauuu

SEQ ID NO: 209105 - RNA, 22 nt, Homo sapiens
uuaucagaaucuccagggguac

SEQ ID NO: 209106 - RNA, 22 nt, Homo sapiens
aacacaccuauucaaggauuca

SEQ ID NO: 209107 - RNA, 24 nt, Homo sapiens
aauccuuggaaccuaggugugagu

SEQ ID NO: 209108 - RNA, 22 nt, Homo sapiens
aauugcacgguauccaucugua

SEQ ID NO: 209109 - RNA, 22 nt, Homo sapiens
cggguggaucacgaugcaauuu

SEQ ID NO: 209110 - RNA, 22 nt, Homo sapiens
uaaugccccuaaaaauccuuau

SEQ ID NO: 209111 - RNA, 23 nt, Homo sapiens
agggacuuuugggggcagaugug

SEQ ID NO: 209112 - RNA, 22 nt, Homo sapiens
uaaugccccuaaaaauccuuau

SEQ ID NO: 209113 - RNA, 22 nt, Homo sapiens
agggacuuucaggggcagcugu

SEQ ID NO: 209114 - RNA, 22 nt, Homo sapiens
aauugcacuuuagcaaugguga

SEQ ID NO: 209115 - RNA, 22 nt, Homo sapiens
acuguugcuaauaugcaacucu

SEQ ID NO: 209116 - RNA, 21 nt, Homo sapiens
aauaauacaugguugaucuuu

SEQ ID NO: 209117 - RNA, 22 nt, Homo sapiens
agaucgaccguguuauauucgc

SEQ ID NO: 209118 - RNA, 22 nt, Homo sapiens
gccugcugggguggaaccuggu

SEQ ID NO: 209119 - RNA, 23 nt, Homo sapiens
aagugccgccaucuuuugagugu

SEQ ID NO: 209120 - RNA, 20 nt, Homo sapiens
acucaaacugugggggcacu

SEQ ID NO: 209121 - RNA, 23 nt, Homo sapiens
aagugcccccacaguuugagugc

SEQ ID NO: 209122 - RNA, 22 nt, Homo sapiens
acucaaaagauggcggcacuuu

SEQ ID NO: 209123 - RNA, 23 nt, Homo sapiens
aaagugcugcgacauuugagcgu

SEQ ID NO: 209124 - RNA, 23 nt, Homo sapiens
gaagugcuucgauuuuggggugu

SEQ ID NO: 209125 - RNA, 22 nt, Homo sapiens
acucaaaaugggggcgcuuucc

SEQ ID NO: 209126 - RNA, 22 nt, Homo sapiens
cuuaucagauuguauuguaauu

SEQ ID NO: 209127 - RNA, 22 nt, Homo sapiens
uuauaauacaaccugauaagug

SEQ ID NO: 209128 - RNA, 22 nt, Homo sapiens
cuuagcagguuguauuaucauu

SEQ ID NO: 209129 - RNA, 22 nt, Homo sapiens
auauaauacaaccugcuaagug

SEQ ID NO: 209130 - RNA, 22 nt, Homo sapiens
cacuuagcagguuguauuauau

SEQ ID NO: 209131 - RNA, 22 nt, Homo sapiens
auaauacaaccugcuaagugcu

SEQ ID NO: 209132 - RNA, 22 nt, Homo sapiens
uuuguucguucggcucgcguga

SEQ ID NO: 209133 - RNA, 21 nt, Homo sapiens
gguagauuuuccuucuauggu

SEQ ID NO: 209134 - RNA, 21 nt, Homo sapiens
aucauagaggaaaauccacgu

SEQ ID NO: 209135 - RNA, 22 nt, Homo sapiens
guagauucuccuucuaugagua

SEQ ID NO: 209136 - RNA, 22 nt, Homo sapiens
aucauagaggaaaauccauguu

SEQ ID NO: 209137 - RNA, 22 nt, Homo sapiens
cguggauauuccuucuauguuu

SEQ ID NO: 209138 - RNA, 21 nt, Homo sapiens
aacauagaggaaauuccacgu

SEQ ID NO: 209139 - RNA, 21 nt, Homo sapiens
gguggauauuccuucuauguu

SEQ ID NO: 209140 - RNA, 22 nt, Homo sapiens
aucacacaaaggcaacuuuugu

SEQ ID NO: 209141 - RNA, 22 nt, Homo sapiens
agagguugcccuuggugaauuc

SEQ ID NO: 209142 - RNA, 21 nt, Homo sapiens
acuggacuuggagucagaagg

SEQ ID NO: 209143 - RNA, 22 nt, Homo sapiens
cuccugacuccagguccugugu

SEQ ID NO: 209144 - RNA, 19 nt, Homo sapiens
acuggacuuggaggcagaa

SEQ ID NO: 209145 - RNA, 25 nt, Homo sapiens
acuggacuuggagucagaagagugg

SEQ ID NO: 209146 - RNA, 20 nt, Homo sapiens
acuggacuuggagucagaaa

SEQ ID NO: 209147 - RNA, 19 nt, Homo sapiens
acuggacuuggagucagga

SEQ ID NO: 209148 - RNA, 20 nt, Homo sapiens
acuggacuuggagccagaag

SEQ ID NO: 209149 - RNA, 20 nt, Homo sapiens
acugggcuuggagucagaag

SEQ ID NO: 209150 - RNA, 21 nt, Homo sapiens
acuggacuuggugucagaugg

SEQ ID NO: 209151 - RNA, 21 nt, Homo sapiens
acuggacuaggagucagaagg

SEQ ID NO: 209152 - RNA, 19 nt, Homo sapiens
acuggauuuggagccagaa

SEQ ID NO: 209153 - RNA, 22 nt, Homo sapiens
uauguaacaugguccacuaacu

SEQ ID NO: 209154 - RNA, 21 nt, Homo sapiens
ugguagacuauggaacguagg

SEQ ID NO: 209155 - RNA, 22 nt, Homo sapiens
uauguaauaugguccacaucuu

SEQ ID NO: 209156 - RNA, 22 nt, Homo sapiens
ugguugaccauagaacaugcgc

SEQ ID NO: 209157 - RNA, 22 nt, Homo sapiens
uauacaagggcaagcucucugu

SEQ ID NO: 209158 - RNA, 22 nt, Homo sapiens
agcgagguugcccuuuguauau

SEQ ID NO: 209159 - RNA, 21 nt, Homo sapiens
aaucauucacggacaacacuu

SEQ ID NO: 209160 - RNA, 22 nt, Homo sapiens
gaaguuguucgugguggauucg

SEQ ID NO: 209161 - RNA, 22 nt, Homo sapiens
agaucagaaggugauuguggcu

SEQ ID NO: 209162 - RNA, 20 nt, Homo sapiens
auuccuagaaauuguucaua

SEQ ID NO: 209163 - RNA, 22 nt, Homo sapiens
gaauguugcucggugaaccccu

SEQ ID NO: 209164 - RNA, 23 nt, Homo sapiens
agguuacccgagcaacuuugcau

SEQ ID NO: 209165 - RNA, 21 nt, Homo sapiens
aauauaacacagauggccugu

SEQ ID NO: 209166 - RNA, 22 nt, Homo sapiens
uauguaacacgguccacuaacc

SEQ ID NO: 209167 - RNA, 21 nt, Homo sapiens
uaguagaccguauagcguacg

SEQ ID NO: 209168 - RNA, 23 nt, Homo sapiens
acuucaccugguccacuagccgu

SEQ ID NO: 209169 - RNA, 23 nt, Homo sapiens
aucaacagacauuaauugggcgc

SEQ ID NO: 209170 - RNA, 22 nt, Homo sapiens
acuggacuuagggucagaaggc

SEQ ID NO: 209171 - RNA, 23 nt, Homo sapiens
agcucggucugaggccccucagu

SEQ ID NO: 209172 - RNA, 23 nt, Homo sapiens
ugaggggcagagagcgagacuuu

SEQ ID NO: 209173 - RNA, 21 nt, Homo sapiens
caaaacgugaggcgcugcuau

SEQ ID NO: 209174 - RNA, 22 nt, Homo sapiens
cagcagcaauucauguuuugaa

SEQ ID NO: 209175 - RNA, 22 nt, Homo sapiens
aucgggaaugucguguccgccc

SEQ ID NO: 209176 - RNA, 23 nt, Homo sapiens
aaugacacgaucacucccguuga

SEQ ID NO: 209177 - RNA, 22 nt, Homo sapiens
uaauacugucugguaaaaccgu

SEQ ID NO: 209178 - RNA, 22 nt, Homo sapiens
caggucgucuugcagggcuucu

SEQ ID NO: 209179 - RNA, 21 nt, Homo sapiens
ugucuugcaggccgucaugca

SEQ ID NO: 209180 - RNA, 21 nt, Homo sapiens
cuggauggcuccuccaugucu

SEQ ID NO: 209181 - RNA, 23 nt, Homo sapiens
ucuuggaguaggucauugggugg

SEQ ID NO: 209182 - RNA, 22 nt, Homo sapiens
aucaugaugggcuccucggugu

SEQ ID NO: 209183 - RNA, 22 nt, Homo sapiens
uugcauauguaggaugucccau

SEQ ID NO: 209184 - RNA, 22 nt, Homo sapiens
uggcaguguauuguuagcuggu

SEQ ID NO: 209185 - RNA, 22 nt, Homo sapiens
cagccacaacuacccugccacu

SEQ ID NO: 209186 - RNA, 22 nt, Homo sapiens
aggcaguguauuguuagcuggc

SEQ ID NO: 209187 - RNA, 23 nt, Homo sapiens
uugcuaguugcacuccucucugu

SEQ ID NO: 209188 - RNA, 25 nt, Homo sapiens
uaggcaguguauugcuagcggcugu

SEQ ID NO: 209189 - RNA, 22 nt, Homo sapiens
auuggggacauuuugcauucau

SEQ ID NO: 209190 - RNA, 22 nt, Homo sapiens
uuuugcgauguguuccuaauau

SEQ ID NO: 209191 - RNA, 22 nt, Homo sapiens
uugggaucauuuugcauccaua

SEQ ID NO: 209192 - RNA, 22 nt, Homo sapiens
uuuugcaauauguuccugaaua

SEQ ID NO: 209193 - RNA, 22 nt, Homo sapiens
aaaccguuaccauuacugaguu

SEQ ID NO: 209194 - RNA, 22 nt, Homo sapiens
uagcaagagaaccauuaccauu

SEQ ID NO: 209195 - RNA, 22 nt, Homo sapiens
cucaucugcaaagaaguaagug

SEQ ID NO: 209196 - RNA, 22 nt, Homo sapiens
aacuguuugcagaggaaacuga

SEQ ID NO: 209197 - RNA, 23 nt, Homo sapiens
uagugcaauauugcuuauagggu

SEQ ID NO: 209198 - RNA, 22 nt, Homo sapiens
acccuaucaauauugucucugc

SEQ ID NO: 209199 - RNA, 21 nt, Homo sapiens
gcaguccaugggcauauacac

SEQ ID NO: 209200 - RNA, 22 nt, Homo sapiens
uaugugccuuuggacuacaucg

SEQ ID NO: 209201 - RNA, 23 nt, Homo sapiens
auacacauacacgcaacacacau

SEQ ID NO: 209202 - RNA, 21 nt, Homo sapiens
ucacuccucuccucccgucuu

SEQ ID NO: 209203 - RNA, 22 nt, Homo sapiens
aagacgggaggaaagaagggag

SEQ ID NO: 209204 - RNA, 22 nt, Homo sapiens
ucaggcucaguccccucccgau

SEQ ID NO: 209205 - RNA, 22 nt, Homo sapiens
gucauacacggcucuccucucu

SEQ ID NO: 209206 - RNA, 22 nt, Homo sapiens
agaggcuggccgugaugaauuc

SEQ ID NO: 209207 - RNA, 21 nt, Homo sapiens
cggggcagcucaguacaggau

SEQ ID NO: 209208 - RNA, 22 nt, Homo sapiens
uccuguacugagcugccccgag

SEQ ID NO: 209209 - RNA, 22 nt, Homo sapiens
aaucauacagggacauccaguu

SEQ ID NO: 209210 - RNA, 22 nt, Homo sapiens
aaucguacagggucauccacuu

SEQ ID NO: 209211 - RNA, 21 nt, Homo sapiens
uugaaaggcuauuucuugguc

SEQ ID NO: 209212 - RNA, 21 nt, Homo sapiens
cccagauaauggcacucucaa

SEQ ID NO: 209213 - RNA, 22 nt, Homo sapiens
gugacaucacauauacggcagc

SEQ ID NO: 209214 - RNA, 22 nt, Homo sapiens
caaccuggaggacuccaugcug

SEQ ID NO: 209215 - RNA, 20 nt, Homo sapiens
ccauggaucuccaggugggu

SEQ ID NO: 209216 - RNA, 22 nt, Homo sapiens
cuuaugcaagauucccuucuac

SEQ ID NO: 209217 - RNA, 22 nt, Homo sapiens
aguggggaacccuuccaugagg

SEQ ID NO: 209218 - RNA, 23 nt, Homo sapiens
aggaccugcgggacaagauucuu

SEQ ID NO: 209219 - RNA, 22 nt, Homo sapiens
ugaaggucuacugugugccagg

SEQ ID NO: 209220 - RNA, 22 nt, Homo sapiens
uuguacaugguaggcuuucauu

SEQ ID NO: 209221 - RNA, 22 nt, Homo sapiens
ugaaacauacacgggaaaccuc

SEQ ID NO: 209222 - RNA, 22 nt, Homo sapiens
aaacaaacauggugcacuucuu

SEQ ID NO: 209223 - RNA, 22 nt, Homo sapiens
gaaguugcccauguuauuuucg

SEQ ID NO: 209224 - RNA, 22 nt, Homo sapiens
ugaguauuacauggccaaucuc

SEQ ID NO: 209225 - RNA, 22 nt, Homo sapiens
caaaccacacugugguguuaga

SEQ ID NO: 209226 - RNA, 21 nt, Homo sapiens
cagcagcacacugugguuugu

SEQ ID NO: 209227 - RNA, 23 nt, Homo sapiens
uuucaagccagggggcguuuuuc

SEQ ID NO: 209228 - RNA, 22 nt, Homo sapiens
augcaccugggcaaggauucug

SEQ ID NO: 209229 - RNA, 23 nt, Homo sapiens
uaauccuugcuaccugggugaga

SEQ ID NO: 209230 - RNA, 18 nt, Homo sapiens
aauccuugcuaccugggu

SEQ ID NO: 209231 - RNA, 22 nt, Homo sapiens
aaugcacccgggcaaggauucu

SEQ ID NO: 209232 - RNA, 22 nt, Homo sapiens
aauccuuugucccugggugaga

SEQ ID NO: 209233 - RNA, 22 nt, Homo sapiens
aaugcaccugggcaaggauuca

SEQ ID NO: 209234 - RNA, 21 nt, Homo sapiens
auccuugcuaucugggugcua

SEQ ID NO: 209235 - RNA, 23 nt, Homo sapiens
gggguauuguuuccgcugccagg

SEQ ID NO: 209236 - RNA, 23 nt, Homo sapiens
uagcagcgggaacaguucugcag

SEQ ID NO: 209237 - RNA, 22 nt, Homo sapiens
agacccuggucugcacucuauc

SEQ ID NO: 209238 - RNA, 22 nt, Homo sapiens
cgucaacacuugcugguuuccu

SEQ ID NO: 209239 - RNA, 22 nt, Homo sapiens
gggagccaggaaguauugaugu

SEQ ID NO: 209240 - RNA, 21 nt, Homo sapiens
uaaggcacccuucugaguaga

SEQ ID NO: 209241 - RNA, 22 nt, Homo sapiens
uauucaggaagguguuacuuaa

SEQ ID NO: 209242 - RNA, 21 nt, Homo sapiens
uuuugcaccuuuuggagugaa

SEQ ID NO: 209243 - RNA, 23 nt, Homo sapiens
ugauuguagccuuuuggaguaga

SEQ ID NO: 209244 - RNA, 23 nt, Homo sapiens
uacuccagagggcgucacucaug

SEQ ID NO: 209245 - RNA, 22 nt, Homo sapiens
uacugcagacguggcaaucaug

SEQ ID NO: 209246 - RNA, 22 nt, Homo sapiens
ugauugguacgucuguggguag

SEQ ID NO: 209247 - RNA, 21 nt, Homo sapiens
uacugcagacaguggcaauca

SEQ ID NO: 209248 - RNA, 22 nt, Homo sapiens
uacucaggagaguggcaaucac

SEQ ID NO: 209249 - RNA, 21 nt, Homo sapiens
gugucuuuugcucugcaguca

SEQ ID NO: 209250 - RNA, 22 nt, Homo sapiens
aagugcugucauagcugagguc

SEQ ID NO: 209251 - RNA, 23 nt, Homo sapiens
cacucagccuugagggcacuuuc

SEQ ID NO: 209252 - RNA, 23 nt, Homo sapiens
uaaauuucaccuuucugagaagg

SEQ ID NO: 209253 - RNA, 18 nt, Homo sapiens
uucacagggaggugucau

SEQ ID NO: 209254 - RNA, 22 nt, Homo sapiens
uucacaaggaggugucauuuau

SEQ ID NO: 209255 - RNA, 23 nt, Homo sapiens
uaaauuucaccuuucugagaaga

SEQ ID NO: 209256 - RNA, 22 nt, Homo sapiens
uucucaaggaggugucguuuau

SEQ ID NO: 209257 - RNA, 21 nt, Homo sapiens
auugacacuucugugaguaga

SEQ ID NO: 209258 - RNA, 23 nt, Homo sapiens
uacucuggagagugacaaucaug

SEQ ID NO: 209259 - RNA, 21 nt, Homo sapiens
auugacaccucugugagugga

SEQ ID NO: 209260 - RNA, 22 nt, Homo sapiens
uucucaagagggaggcaaucau

SEQ ID NO: 209261 - RNA, 22 nt, Homo sapiens
gagugccuucuuuuggagcguu

SEQ ID NO: 209262 - RNA, 24 nt, Homo sapiens
uucuccaaaagaaagcacuuucug

SEQ ID NO: 209263 - RNA, 18 nt, Homo sapiens
ugcuuccuuucagagggu

SEQ ID NO: 209264 - RNA, 23 nt, Homo sapiens
uucucgaggaaagaagcacuuuc

SEQ ID NO: 209265 - RNA, 18 nt, Homo sapiens
ugcuuccuuucagagggu

SEQ ID NO: 209266 - RNA, 22 nt, Homo sapiens
aucuggagguaagaagcacuuu

SEQ ID NO: 209267 - RNA, 22 nt, Homo sapiens
ccucuagauggaagcacugucu

SEQ ID NO: 209268 - RNA, 22 nt, Homo sapiens
aucgugcaucccuuuagagugu

SEQ ID NO: 209269 - RNA, 22 nt, Homo sapiens
aucgugcaucccuuuagagugu

SEQ ID NO: 209270 - RNA, 22 nt, Homo sapiens
aucgugcauccuuuuagagugu

SEQ ID NO: 209271 - RNA, 22 nt, Homo sapiens
gaaagcgcuucccuuugcugga

SEQ ID NO: 209272 - RNA, 20 nt, Homo sapiens
cugcaaagggaagcccuuuc

SEQ ID NO: 209273 - RNA, 22 nt, Homo sapiens
caaagcgcuccccuuuagaggu

SEQ ID NO: 209274 - RNA, 23 nt, Homo sapiens
caaagcgcuucucuuuagagugu

SEQ ID NO: 209275 - RNA, 23 nt, Homo sapiens
ucucuggagggaagcacuuucug

SEQ ID NO: 209276 - RNA, 21 nt, Homo sapiens
caaagcgcuucccuuuggagc

SEQ ID NO: 209277 - RNA, 22 nt, Homo sapiens
cucuagagggaagcacuuucug

SEQ ID NO: 209278 - RNA, 21 nt, Homo sapiens
aaagcgcuucccuucagagug

SEQ ID NO: 209279 - RNA, 22 nt, Homo sapiens
cucuagagggaagcgcuuucug

SEQ ID NO: 209280 - RNA, 21 nt, Homo sapiens
gaaagcgcuucucuuuagagg

SEQ ID NO: 209281 - RNA, 22 nt, Homo sapiens
cucuagagggaagcacuuucuc

SEQ ID NO: 209282 - RNA, 22 nt, Homo sapiens
aaagugcauccuuuuagagugu

SEQ ID NO: 209283 - RNA, 22 nt, Homo sapiens
cucuagagggaagcgcuuucug

SEQ ID NO: 209284 - RNA, 22 nt, Homo sapiens
aaagugcauccuuuuagagguu

SEQ ID NO: 209285 - RNA, 22 nt, Homo sapiens
cucuagagggaagcgcuuucug

SEQ ID NO: 209286 - RNA, 22 nt, Homo sapiens
aaagugcaucuuuuuagaggau

SEQ ID NO: 209287 - RNA, 22 nt, Homo sapiens
cucuagagggaagcgcuuucug

SEQ ID NO: 209288 - RNA, 22 nt, Homo sapiens
caaagugccucccuuuagagug

SEQ ID NO: 209289 - RNA, 22 nt, Homo sapiens
aagugccuccuuuuagaguguu

SEQ ID NO: 209290 - RNA, 22 nt, Homo sapiens
uucuccaaaagggagcacuuuc

SEQ ID NO: 209291 - RNA, 22 nt, Homo sapiens
aaagugcuucccuuuggacugu

SEQ ID NO: 209292 - RNA, 21 nt, Homo sapiens
cuccagagggaaguacuuucu

SEQ ID NO: 209293 - RNA, 21 nt, Homo sapiens
aaagugcuuccuuuuagaggg

SEQ ID NO: 209294 - RNA, 22 nt, Homo sapiens
aaagugcuuccuuuuagagggu

SEQ ID NO: 209295 - RNA, 22 nt, Homo sapiens
cucuagagggaagcacuuucug

SEQ ID NO: 209296 - RNA, 22 nt, Homo sapiens
aaagugcuucucuuuggugggu

SEQ ID NO: 209297 - RNA, 20 nt, Homo sapiens
cuacaaagggaagcccuuuc

SEQ ID NO: 209298 - RNA, 21 nt, Homo sapiens
aaagugcuuccuuuuugaggg

SEQ ID NO: 209299 - RNA, 22 nt, Homo sapiens
aagugcuuccuuuuagaggguu

SEQ ID NO: 209300 - RNA, 24 nt, Homo sapiens
acaaagugcuucccuuuagagugu

SEQ ID NO: 209301 - RNA, 22 nt, Homo sapiens
acaaagugcuucccuuuagagu

SEQ ID NO: 209302 - RNA, 22 nt, Homo sapiens
aacgcacuucccuuuagagugu

SEQ ID NO: 209303 - RNA, 22 nt, Homo sapiens
aaaaugguucccuuuagagugu

SEQ ID NO: 209304 - RNA, 22 nt, Homo sapiens
cucuagagggaagcgcuuucug

SEQ ID NO: 209305 - RNA, 23 nt, Homo sapiens
gaacgcgcuucccuauagagggu

SEQ ID NO: 209306 - RNA, 22 nt, Homo sapiens
cucuagagggaagcgcuuucug

SEQ ID NO: 209307 - RNA, 21 nt, Homo sapiens
gaaggcgcuucccuuuggagu

SEQ ID NO: 209308 - RNA, 22 nt, Homo sapiens
cuacaaagggaagcacuuucuc

SEQ ID NO: 209309 - RNA, 22 nt, Homo sapiens
gaaggcgcuucccuuuagagcg

SEQ ID NO: 209310 - RNA, 21 nt, Homo sapiens
cuccagagggaugcacuuucu

SEQ ID NO: 209311 - RNA, 22 nt, Homo sapiens
cucuagagggaagcacuuucug

SEQ ID NO: 209312 - RNA, 22 nt, Homo sapiens
gaaagugcuuccuuuuagaggc

SEQ ID NO: 209313 - RNA, 23 nt, Homo sapiens
cucuugagggaagcacuuucugu

SEQ ID NO: 209314 - RNA, 20 nt, Homo sapiens
cugcaaagggaagcccuuuc

SEQ ID NO: 209315 - RNA, 22 nt, Homo sapiens
ccucccacacccaaggcuugca

SEQ ID NO: 209316 - RNA, 22 nt, Homo sapiens
caugccuugaguguaggaccgu

SEQ ID NO: 209317 - RNA, 22 nt, Homo sapiens
aucauacaaggacaauuucuuu

SEQ ID NO: 209318 - RNA, 22 nt, Homo sapiens
ggagaaauuauccuuggugugu

SEQ ID NO: 209319 - RNA, 22 nt, Homo sapiens
uggugggcacagaaucuggacu

SEQ ID NO: 209320 - RNA, 25 nt, Homo sapiens
aaaggauucugcugucggucccacu

SEQ ID NO: 209321 - RNA, 22 nt, Homo sapiens
ugugacagauugauaacugaaa

SEQ ID NO: 209322 - RNA, 23 nt, Homo sapiens
ucggggaucaucaugucacgaga

SEQ ID NO: 209323 - RNA, 22 nt, Homo sapiens
aaacauucgcggugcacuucuu

SEQ ID NO: 209324 - RNA, 22 nt, Homo sapiens
auucugcauuuuuagcaaguuc

SEQ ID NO: 209325 - RNA, 22 nt, Homo sapiens
accugagguugugcauuucuaa

SEQ ID NO: 209326 - RNA, 22 nt, Homo sapiens
ucagcaaacauuuauugugugc

SEQ ID NO: 209327 - RNA, 22 nt, Homo sapiens
ucaguaaauguuuauuagauga

SEQ ID NO: 209328 - RNA, 22 nt, Homo sapiens
agcuacaguuacuuuugcacca

SEQ ID NO: 209329 - RNA, 20 nt, Homo sapiens
uaaaaacugcaauuacuuuc

SEQ ID NO: 209330 - RNA, 23 nt, Homo sapiens
ugcaaaaguaauugcaguuuuug

SEQ ID NO: 209331 - RNA, 22 nt, Homo sapiens
agaaguaauugcgguuuugcca

SEQ ID NO: 209332 - RNA, 22 nt, Homo sapiens
caaaacuggcaauuacuuuugc

SEQ ID NO: 209333 - RNA, 22 nt, Homo sapiens
aaaaguaauugcgaguuuuacc

SEQ ID NO: 209334 - RNA, 25 nt, Homo sapiens
aaaaaccacaauuacuuuugcacca

SEQ ID NO: 209335 - RNA, 22 nt, Homo sapiens
aaaaguaauuguggauuuugcu

SEQ ID NO: 209336 - RNA, 22 nt, Homo sapiens
caaaaaccggcaauuacuuuug

SEQ ID NO: 209337 - RNA, 22 nt, Homo sapiens
gaaaacgacaaugacuuuugca

SEQ ID NO: 209338 - RNA, 21 nt, Homo sapiens
caaaaacugcaauuacuuuca

SEQ ID NO: 209339 - RNA, 21 nt, Homo sapiens
aaagguaauugugguuucugc

SEQ ID NO: 209340 - RNA, 22 nt, Homo sapiens
caaaaacugcaguuacuuuugc

SEQ ID NO: 209341 - RNA, 20 nt, Homo sapiens
aaaagugauugcaguguuug

SEQ ID NO: 209342 - RNA, 22 nt, Homo sapiens
aaagguaauugcaguuuuuccc

SEQ ID NO: 209343 - RNA, 21 nt, Homo sapiens
uaaaaacugcaauuacuuuua

SEQ ID NO: 209344 - RNA, 23 nt, Homo sapiens
ugcaaaaguaauugcaguuuuug

SEQ ID NO: 209345 - RNA, 21 nt, Homo sapiens
aaaaguaacugcgguuuuuga

SEQ ID NO: 209346 - RNA, 22 nt, Homo sapiens
aacggcaaugacuuuuguacca

SEQ ID NO: 209347 - RNA, 22 nt, Homo sapiens
caaaaacugcaguuacuuuugu

SEQ ID NO: 209348 - RNA, 22 nt, Homo sapiens
aaaaguaauugcgguuuuugcc

SEQ ID NO: 209349 - RNA, 20 nt, Homo sapiens
aaaaggcauugugguuuuug

SEQ ID NO: 209350 - RNA, 22 nt, Homo sapiens
aaagaccgugacuacuuuugca

SEQ ID NO: 209351 - RNA, 22 nt, Homo sapiens
agaaguaacuacgguuuuugca

SEQ ID NO: 209352 - RNA, 19 nt, Homo sapiens
aaaaaccacaauuacuuuu

SEQ ID NO: 209353 - RNA, 19 nt, Homo sapiens
aaaaguaauugcggucuuu

SEQ ID NO: 209354 - RNA, 22 nt, Homo sapiens
caaaaacugcaauuacuuuugc

SEQ ID NO: 209355 - RNA, 22 nt, Homo sapiens
gaaaguaauugcuguuuuugcc

SEQ ID NO: 209356 - RNA, 21 nt, Homo sapiens
uaaaacugcaguuauuuuugc

SEQ ID NO: 209357 - RNA, 21 nt, Homo sapiens
aaaaguaauugcaguuuuugc

SEQ ID NO: 209358 - RNA, 22 nt, Homo sapiens
uaaaacccacaauuauguuugu

SEQ ID NO: 209359 - RNA, 22 nt, Homo sapiens
aaaaguaauugcggguuuugcc

SEQ ID NO: 209360 - RNA, 21 nt, Homo sapiens
caaaaccgcaguaacuuuugu

SEQ ID NO: 209361 - RNA, 22 nt, Homo sapiens
aaaaguuauugcgguuuuggcu

SEQ ID NO: 209362 - RNA, 21 nt, Homo sapiens
uggcaguuacuuuugcaccag

SEQ ID NO: 209363 - RNA, 21 nt, Homo sapiens
aaaaguaauugcgguuuuugc

SEQ ID NO: 209364 - RNA, 20 nt, Homo sapiens
aaaacugcaguuacuuuugc

SEQ ID NO: 209365 - RNA, 18 nt, Homo sapiens
aaaaguacuugcggauuu

SEQ ID NO: 209366 - RNA, 20 nt, Homo sapiens
gugcaaaagucaucacgguu

SEQ ID NO: 209367 - RNA, 22 nt, Homo sapiens
caaaaccgcgauuacucuugca

SEQ ID NO: 209368 - RNA, 21 nt, Homo sapiens
aaaaguaauugugguuuuugc

SEQ ID NO: 209369 - RNA, 21 nt, Homo sapiens
aaaaacugcaaucacuuuugc

SEQ ID NO: 209370 - RNA, 22 nt, Homo sapiens
caaaagugauugugguuuuugc

SEQ ID NO: 209371 - RNA, 22 nt, Homo sapiens
caagaaccucaguugcuuuugu

SEQ ID NO: 209372 - RNA, 22 nt, Homo sapiens
aaaaguaauugugguuuuggcc

SEQ ID NO: 209373 - RNA, 22 nt, Homo sapiens
caaaaaucucaauuacuuuugc

SEQ ID NO: 209374 - RNA, 22 nt, Homo sapiens
aaaaguaauugcgguuuuugcc

SEQ ID NO: 209375 - RNA, 22 nt, Homo sapiens
caaaaaccacaguuucuuuugc

SEQ ID NO: 209376 - RNA, 22 nt, Homo sapiens
aaaaguaauugugguuuuugcc

SEQ ID NO: 209377 - RNA, 22 nt, Homo sapiens
aaaaacugagacuacuuuugca

SEQ ID NO: 209378 - RNA, 19 nt, Homo sapiens
aaaaacuguaauuacuuuu

SEQ ID NO: 209379 - RNA, 22 nt, Homo sapiens
aaaacuguaauuacuuuuguac

SEQ ID NO: 209380 - RNA, 23 nt, Homo sapiens
ugcaaaaguaauugcaguuuuug

SEQ ID NO: 209381 - RNA, 23 nt, Homo sapiens
caaaaaccgcaauuacuuuugca

SEQ ID NO: 209382 - RNA, 22 nt, Homo sapiens
aaaaguaaucgcgguuuuuguc

SEQ ID NO: 209383 - RNA, 22 nt, Homo sapiens
aaaaguaauugcggauuuugcc

SEQ ID NO: 209384 - RNA, 22 nt, Homo sapiens
aaaaguaauugcggucuuuggu

SEQ ID NO: 209385 - RNA, 22 nt, Homo sapiens
aaaaguacuugcggauuuugcu

SEQ ID NO: 209386 - RNA, 22 nt, Homo sapiens
aaaaguauuugcggguuuuguc

SEQ ID NO: 209387 - RNA, 21 nt, Homo sapiens
caaagguauuugugguuuuug

SEQ ID NO: 209388 - RNA, 22 nt, Homo sapiens
caaaaguaauuguggauuuugu

SEQ ID NO: 209389 - RNA, 22 nt, Homo sapiens
ccaaaacugcaguuacuuuugc

SEQ ID NO: 209390 - RNA, 22 nt, Homo sapiens
aaaaguaauugcgguuuuugcc

SEQ ID NO: 209391 - RNA, 22 nt, Homo sapiens
uagcaaaaacugcaguuacuuu

SEQ ID NO: 209392 - RNA, 22 nt, Homo sapiens
gcuggugcaaaaguaauggcgg

SEQ ID NO: 209393 - RNA, 23 nt, Homo sapiens
auggccaaaacugcaguuauuuu

SEQ ID NO: 209394 - RNA, 25 nt, Homo sapiens
aaaaaccacaauuacuuuugcacca

SEQ ID NO: 209395 - RNA, 21 nt, Homo sapiens
caaaagugaucgugguuuuug

SEQ ID NO: 209396 - RNA, 23 nt, Homo sapiens
caaagacugcaauuacuuuugcg

SEQ ID NO: 209397 - RNA, 23 nt, Homo sapiens
aaaaguaacugcgguuuuugccu

SEQ ID NO: 209398 - RNA, 22 nt, Homo sapiens
aaaaguaaucacuguuuuugcc

SEQ ID NO: 209399 - RNA, 23 nt, Homo sapiens
caaaaaccgcaauuacuuuugca

SEQ ID NO: 209400 - RNA, 21 nt, Homo sapiens
ugacaacuauggaugagcucu

SEQ ID NO: 209401 - RNA, 20 nt, Homo sapiens
agugccugagggaguaagag

SEQ ID NO: 209402 - RNA, 22 nt, Homo sapiens
ugucuuacucccucaggcacau

SEQ ID NO: 209403 - RNA, 23 nt, Homo sapiens
agugccugagggaguaagagccc

SEQ ID NO: 209404 - RNA, 22 nt, Homo sapiens
augugccugagggaguaagaca

SEQ ID NO: 209405 - RNA, 20 nt, Homo sapiens
ucuuacucccucaggcacug

SEQ ID NO: 209406 - RNA, 21 nt, Homo sapiens
gcgacccacucuugguuucca

SEQ ID NO: 209407 - RNA, 21 nt, Homo sapiens
gcgacccauacuugguuucag

SEQ ID NO: 209408 - RNA, 22 nt, Homo sapiens
gaaaucaagcgugggugagacc

SEQ ID NO: 209409 - RNA, 21 nt, Homo sapiens
aacaggugacugguuagacaa

SEQ ID NO: 209410 - RNA, 21 nt, Homo sapiens
aaaacggugagauuuuguuuu

SEQ ID NO: 209411 - RNA, 21 nt, Homo sapiens
gcuaguccugacucagccagu

SEQ ID NO: 209412 - RNA, 21 nt, Homo sapiens
aggguaagcugaaccucugau

SEQ ID NO: 209413 - RNA, 22 nt, Homo sapiens
auauuaccauuagcucaucuuu

SEQ ID NO: 209414 - RNA, 22 nt, Homo sapiens
gaugagcucauuguaauaugag

SEQ ID NO: 209415 - RNA, 23 nt, Homo sapiens
guuugcacgggugggccuugucu

SEQ ID NO: 209416 - RNA, 19 nt, Homo sapiens
ugagcugcuguaccaaaau

SEQ ID NO: 209417 - RNA, 21 nt, Homo sapiens
uaaaguaaauaugcaccaaaa

SEQ ID NO: 209418 - RNA, 22 nt, Homo sapiens
caaaguuuaagauccuugaagu

SEQ ID NO: 209419 - RNA, 22 nt, Homo sapiens
aucaaggaucuuaaacuuugcc

SEQ ID NO: 209420 - RNA, 20 nt, Homo sapiens
aaaguagcuguaccauuugc

SEQ ID NO: 209421 - RNA, 19 nt, Homo sapiens
agguugacauacguuuccc

SEQ ID NO: 209422 - RNA, 19 nt, Homo sapiens
aggcacggugucagcaggc

SEQ ID NO: 209423 - RNA, 19 nt, Homo sapiens
gggcgccugugaucccaac

SEQ ID NO: 209424 - RNA, 23 nt, Homo sapiens
aguauguucuuccaggacagaac

SEQ ID NO: 209425 - RNA, 20 nt, Homo sapiens
auguauaaauguauacacac

SEQ ID NO: 209426 - RNA, 21 nt, Homo sapiens
aguuaaugaauccuggaaagu

SEQ ID NO: 209427 - RNA, 22 nt, Homo sapiens
cgaaaacagcaauuaccuuugc

SEQ ID NO: 209428 - RNA, 22 nt, Homo sapiens
aaagguaauugcaguuuuuccc

SEQ ID NO: 209429 - RNA, 21 nt, Homo sapiens
ugaguuggccaucugagugag

SEQ ID NO: 209430 - RNA, 20 nt, Homo sapiens
guccgcucggcgguggccca

SEQ ID NO: 209431 - RNA, 24 nt, Homo sapiens
cugaagugauguguaacugaucag

SEQ ID NO: 209432 - RNA, 22 nt, Homo sapiens
cacgcucaugcacacacccaca

SEQ ID NO: 209433 - RNA, 23 nt, Homo sapiens
ugagugugugugugugagugugu

SEQ ID NO: 209434 - RNA, 19 nt, Homo sapiens
gagccaguuggacaggagc

SEQ ID NO: 209435 - RNA, 22 nt, Homo sapiens
aagauguggaaaaauuggaauc

SEQ ID NO: 209436 - RNA, 22 nt, Homo sapiens
auucuaauuucuccacgucuuu

SEQ ID NO: 209437 - RNA, 21 nt, Homo sapiens
uagauaaaauauugguaccug

SEQ ID NO: 209438 - RNA, 21 nt, Homo sapiens
cuucuugugcucuaggauugu

SEQ ID NO: 209439 - RNA, 23 nt, Homo sapiens
uucauuugguauaaaccgcgauu

SEQ ID NO: 209440 - RNA, 22 nt, Homo sapiens
uugagaaugaugaaucauuagg

SEQ ID NO: 209441 - RNA, 21 nt, Homo sapiens
ucuuguguucucuagaucagu

SEQ ID NO: 209442 - RNA, 22 nt, Homo sapiens
uaacugguugaacaacugaacc

SEQ ID NO: 209443 - RNA, 23 nt, Homo sapiens
uuacaguuguucaaccaguuacu

SEQ ID NO: 209444 - RNA, 21 nt, Homo sapiens
caaagaggaaggucccauuac

SEQ ID NO: 209445 - RNA, 22 nt, Homo sapiens
ucaguuccaggccaaccaggcu

SEQ ID NO: 209446 - RNA, 22 nt, Homo sapiens
uuaugguuugccugggacugag

SEQ ID NO: 209447 - RNA, 19 nt, Homo sapiens
ugggcguaucuguaugcua

SEQ ID NO: 209448 - RNA, 22 nt, Homo sapiens
uaugcauuguauuuuuaggucc

SEQ ID NO: 209449 - RNA, 21 nt, Homo sapiens
uuuccauaggugaugagucac

SEQ ID NO: 209450 - RNA, 21 nt, Homo sapiens
uuggccacaauggguuagaac

SEQ ID NO: 209451 - RNA, 24 nt, Homo sapiens
ucagaacaaaugccgguucccaga

SEQ ID NO: 209452 - RNA, 22 nt, Homo sapiens
ugagaaccacgucugcucugag

SEQ ID NO: 209453 - RNA, 21 nt, Homo sapiens
uaauuuuauguauaagcuagu

SEQ ID NO: 209454 - RNA, 22 nt, Homo sapiens
gagcuuauucauaaaagugcag

SEQ ID NO: 209455 - RNA, 20 nt, Homo sapiens
agaccauggguucucauugu

SEQ ID NO: 209456 - RNA, 22 nt, Homo sapiens
uugugucaauaugcgaugaugu

SEQ ID NO: 209457 - RNA, 19 nt, Homo sapiens
ugucucugcugggguuucu

SEQ ID NO: 209458 - RNA, 25 nt, Homo sapiens
aggcaccagccaggcauugcucagc

SEQ ID NO: 209459 - RNA, 21 nt, Homo sapiens
gaagugugccguggugugucu

SEQ ID NO: 209460 - RNA, 21 nt, Homo sapiens
aagccugcccggcuccucggg

SEQ ID NO: 209461 - RNA, 22 nt, Homo sapiens
ugugucacucgaugaccacugu

SEQ ID NO: 209462 - RNA, 22 nt, Homo sapiens
uacgucaucguugucaucguca

SEQ ID NO: 209463 - RNA, 20 nt, Homo sapiens
guugugucaguuuaucaaac

SEQ ID NO: 209464 - RNA, 23 nt, Homo sapiens
acuuacagacaagagccuugcuc

SEQ ID NO: 209465 - RNA, 22 nt, Homo sapiens
uggucuaggauuguuggaggag

SEQ ID NO: 209466 - RNA, 23 nt, Homo sapiens
gacacgggcgacagcugcggccc

SEQ ID NO: 209467 - RNA, 22 nt, Homo sapiens
cacacacugcaauuacuuuugc

SEQ ID NO: 209468 - RNA, 19 nt, Homo sapiens
aggcugcggaauucaggac

SEQ ID NO: 209469 - RNA, 23 nt, Homo sapiens
uaaaucccauggugccuucuccu

SEQ ID NO: 209470 - RNA, 21 nt, Homo sapiens
aaacuacugaaaaucaaagau

SEQ ID NO: 209471 - RNA, 21 nt, Homo sapiens
guucaaauccagaucuauaac

SEQ ID NO: 209472 - RNA, 25 nt, Homo sapiens
aggggugguguugggacagcuccgu

SEQ ID NO: 209473 - RNA, 20 nt, Homo sapiens
aggguguuucucucaucucu

SEQ ID NO: 209474 - RNA, 21 nt, Homo sapiens
ugagcuaaaugugugcuggga

SEQ ID NO: 209475 - RNA, 23 nt, Homo sapiens
gcgaggaccccucggggucugac

SEQ ID NO: 209476 - RNA, 25 nt, Homo sapiens
gcugggcagggcuucugagcuccuu

SEQ ID NO: 209477 - RNA, 20 nt, Homo sapiens
aggaauguuccuucuuugcc

SEQ ID NO: 209478 - RNA, 23 nt, Homo sapiens
gaacgccuguucuugccaggugg

SEQ ID NO: 209479 - RNA, 22 nt, Homo sapiens
uccgagccugggucucccucuu

SEQ ID NO: 209480 - RNA, 22 nt, Homo sapiens
ggggguccccggugcucggauc

SEQ ID NO: 209481 - RNA, 22 nt, Homo sapiens
agucauuggaggguuugagcag

SEQ ID NO: 209482 - RNA, 22 nt, Homo sapiens
acucaaaacccuucagugacuu

SEQ ID NO: 209483 - RNA, 22 nt, Homo sapiens
agacuucccauuugaagguggc

SEQ ID NO: 209484 - RNA, 23 nt, Homo sapiens
aaacucuacuuguccuucugagu

SEQ ID NO: 209485 - RNA, 24 nt, Homo sapiens
gaccuggacauguuugugcccagu

SEQ ID NO: 209486 - RNA, 20 nt, Homo sapiens
auggagauagauauagaaau

SEQ ID NO: 209487 - RNA, 21 nt, Homo sapiens
ggcuagcaacagcgcuuaccu

SEQ ID NO: 209488 - RNA, 21 nt, Homo sapiens
acagucugcugagguuggagc

SEQ ID NO: 209489 - RNA, 23 nt, Homo sapiens
aucccuugcaggggcuguugggu

SEQ ID NO: 209490 - RNA, 21 nt, Homo sapiens
cacaagguauugguauuaccu

SEQ ID NO: 209491 - RNA, 22 nt, Homo sapiens
uaguaccaguaccuuguguuca

SEQ ID NO: 209492 - RNA, 22 nt, Homo sapiens
gacuauagaacuuucccccuca

SEQ ID NO: 209493 - RNA, 21 nt, Homo sapiens
agggggaaaguucuauagucc

SEQ ID NO: 209494 - RNA, 19 nt, Homo sapiens
agcugucugaaaaugucuu

SEQ ID NO: 209495 - RNA, 22 nt, Homo sapiens
gugagucucuaagaaaagagga

SEQ ID NO: 209496 - RNA, 21 nt, Homo sapiens
ucuaguaagaguggcagucga

SEQ ID NO: 209497 - RNA, 22 nt, Homo sapiens
augcugacauauuuacuagagg

SEQ ID NO: 209498 - RNA, 22 nt, Homo sapiens
guucucccaacguaagcccagc

SEQ ID NO: 209499 - RNA, 21 nt, Homo sapiens
uggguuuacguugggagaacu

SEQ ID NO: 209500 - RNA, 22 nt, Homo sapiens
aguauucuguaccagggaaggu

SEQ ID NO: 209501 - RNA, 21 nt, Homo sapiens
agaccuggcccagaccucagc

SEQ ID NO: 209502 - RNA, 19 nt, Homo sapiens
gugucugcuuccuguggga

SEQ ID NO: 209503 - RNA, 23 nt, Homo sapiens
cuaauaguaucuaccacaauaaa

SEQ ID NO: 209504 - RNA, 22 nt, Homo sapiens
aaccagcaccccaacuuuggac

SEQ ID NO: 209505 - RNA, 23 nt, Homo sapiens
acuugggcacugaaacaaugucc

SEQ ID NO: 209506 - RNA, 23 nt, Homo sapiens
ugugcuugcucgucccgcccgca

SEQ ID NO: 209507 - RNA, 24 nt, Homo sapiens
acugggggcuuucgggcucugcgu

SEQ ID NO: 209508 - RNA, 25 nt, Homo sapiens
agggaucgcgggcggguggcggccu

SEQ ID NO: 209509 - RNA, 23 nt, Homo sapiens
aucgcugcgguugcgagcgcugu

SEQ ID NO: 209510 - RNA, 21 nt, Homo sapiens
augauccaggaaccugccucu

SEQ ID NO: 209511 - RNA, 24 nt, Homo sapiens
aaagacauaggauagagucaccuc

SEQ ID NO: 209512 - RNA, 22 nt, Homo sapiens
agacacauuuggagagggaacc

SEQ ID NO: 209513 - RNA, 22 nt, Homo sapiens
gucccucuccaaaugugucuug

SEQ ID NO: 209514 - RNA, 22 nt, Homo sapiens
agacacauuuggagagggaccc

SEQ ID NO: 209515 - RNA, 22 nt, Homo sapiens
gguucccucuccaaaugugucu

SEQ ID NO: 209516 - RNA, 22 nt, Homo sapiens
acuuguaugcuagcucagguag

SEQ ID NO: 209517 - RNA, 19 nt, Homo sapiens
aguguggcuuucuuagagc

SEQ ID NO: 209518 - RNA, 19 nt, Homo sapiens
ucuaggcugguacugcuga

SEQ ID NO: 209519 - RNA, 19 nt, Homo sapiens
aagcagcugccucugaggc

SEQ ID NO: 209520 - RNA, 21 nt, Homo sapiens
guggcugcacucacuuccuuc

SEQ ID NO: 209521 - RNA, 19 nt, Homo sapiens
aagugugcagggcacuggu

SEQ ID NO: 209522 - RNA, 22 nt, Homo sapiens
aaaccuguguuguucaagaguc

SEQ ID NO: 209523 - RNA, 21 nt, Homo sapiens
aggaggcagcgcucucaggac

SEQ ID NO: 209524 - RNA, 22 nt, Homo sapiens
uuuaggauaagcuugacuuuug

SEQ ID NO: 209525 - RNA, 21 nt, Homo sapiens
aauggcgccacuaggguugug

SEQ ID NO: 209526 - RNA, 25 nt, Homo sapiens
caacccuaggagagggugccauuca

SEQ ID NO: 209527 - RNA, 21 nt, Homo sapiens
guguugaaacaaucucuacug

SEQ ID NO: 209528 - RNA, 22 nt, Homo sapiens
uaugucugcugaccaucaccuu

SEQ ID NO: 209529 - RNA, 22 nt, Homo sapiens
uggugggccgcagaacaugugc

SEQ ID NO: 209530 - RNA, 22 nt, Homo sapiens
auaauacaugguuaaccucuuu

SEQ ID NO: 209531 - RNA, 21 nt, Homo sapiens
aauauuauacagucaaccucu

SEQ ID NO: 209532 - RNA, 23 nt, Homo sapiens
ggcagguucucacccucucuagg

SEQ ID NO: 209533 - RNA, 25 nt, Homo sapiens
ggcggagggaaguagguccguuggu

SEQ ID NO: 209534 - RNA, 22 nt, Homo sapiens
cuugguucagggagggucccca

SEQ ID NO: 209535 - RNA, 22 nt, Homo sapiens
aggaccuucccugaaccaagga

SEQ ID NO: 209536 - RNA, 21 nt, Homo sapiens
accuccugugugcauggauua

SEQ ID NO: 209537 - RNA, 22 nt, Homo sapiens
uacccauugcauaucggaguug

SEQ ID NO: 209538 - RNA, 24 nt, Homo sapiens
ugccugggucucuggccugcgcgu

SEQ ID NO: 209539 - RNA, 21 nt, Homo sapiens
ucccacguuguggcccagcag

SEQ ID NO: 209540 - RNA, 22 nt, Homo sapiens
aggcggggcgccgcgggaccgc

SEQ ID NO: 209541 - RNA, 22 nt, Homo sapiens
gguggcccggccgugccugagg

SEQ ID NO: 209542 - RNA, 23 nt, Homo sapiens
uauucauuuauccccagccuaca

SEQ ID NO: 209543 - RNA, 24 nt, Homo sapiens
acuggcuagggaaaaugauuggau

SEQ ID NO: 209544 - RNA, 22 nt, Homo sapiens
uucauuugccucccagccuaca

SEQ ID NO: 209545 - RNA, 24 nt, Homo sapiens
ugggcuaagggagaugauugggua

SEQ ID NO: 209546 - RNA, 20 nt, Homo sapiens
accaggaggcugaggccccu

SEQ ID NO: 209547 - RNA, 23 nt, Homo sapiens
ugucacucggcucggcccacuac

SEQ ID NO: 209548 - RNA, 20 nt, Homo sapiens
gucccugaguguauguggug

SEQ ID NO: 209549 - RNA, 21 nt, Homo sapiens
uccgguucucagggcuccacc

SEQ ID NO: 209550 - RNA, 23 nt, Homo sapiens
aggaagcccuggaggggcuggag

SEQ ID NO: 209551 - RNA, 20 nt, Homo sapiens
cuguaugcccucaccgcuca

SEQ ID NO: 209552 - RNA, 23 nt, Homo sapiens
uggugcggagagggcccacagug

SEQ ID NO: 209553 - RNA, 21 nt, Homo sapiens
cuguccuaagguuguugaguu

SEQ ID NO: 209554 - RNA, 21 nt, Homo sapiens
ucuucaaccucaggacuugca

SEQ ID NO: 209555 - RNA, 22 nt, Homo sapiens
caacuagacugugagcuucuag

SEQ ID NO: 209556 - RNA, 23 nt, Homo sapiens
aaggagcuuacaaucuagcuggg

SEQ ID NO: 209557 - RNA, 22 nt, Homo sapiens
gggacccagggagagacguaag

SEQ ID NO: 209558 - RNA, 21 nt, Homo sapiens
cuuccgccccgccgggcgucg

SEQ ID NO: 209559 - RNA, 22 nt, Homo sapiens
cuguugccacuaaccucaaccu

SEQ ID NO: 209560 - RNA, 22 nt, Homo sapiens
ugcggggcuagggcuaacagca

SEQ ID NO: 209561 - RNA, 22 nt, Homo sapiens
uuugugaccugguccacuaacc

SEQ ID NO: 209562 - RNA, 22 nt, Homo sapiens
gaugguugaccagagagcacac

SEQ ID NO: 209563 - RNA, 22 nt, Homo sapiens
gcagagugcaaacaauuuugac

SEQ ID NO: 209564 - RNA, 20 nt, Homo sapiens
cggcucugggucugugggga

SEQ ID NO: 209565 - RNA, 22 nt, Homo sapiens
gcagcagggugaaacugacaca

SEQ ID NO: 209566 - RNA, 22 nt, Homo sapiens
ggggcuggggccggggccgagc

SEQ ID NO: 209567 - RNA, 22 nt, Homo sapiens
gcaggugcucacuuguccuccu

SEQ ID NO: 209568 - RNA, 21 nt, Homo sapiens
uggaggagaaggaaggugaug

SEQ ID NO: 209569 - RNA, 22 nt, Homo sapiens
acuccagccccacagccucagc

SEQ ID NO: 209570 - RNA, 22 nt, Homo sapiens
aggaggaauuggugcuggucuu

SEQ ID NO: 209571 - RNA, 23 nt, Homo sapiens
ucugcucauaccccaugguuucu

SEQ ID NO: 209572 - RNA, 23 nt, Homo sapiens
ugcaccaugguugucugagcaug

SEQ ID NO: 209573 - RNA, 23 nt, Homo sapiens
cugggaucuccggggucuugguu

SEQ ID NO: 209574 - RNA, 22 nt, Homo sapiens
ugagaccucuggguucugagcu

SEQ ID NO: 209575 - RNA, 23 nt, Homo sapiens
uccaguaccacgugucagggcca

SEQ ID NO: 209576 - RNA, 23 nt, Homo sapiens
caguaacaaagauucauccuugu

SEQ ID NO: 209577 - RNA, 22 nt, Homo sapiens
ggagacugaugaguucccggga

SEQ ID NO: 209578 - RNA, 21 nt, Homo sapiens
gcaggaacuugugagucuccu

SEQ ID NO: 209579 - RNA, 22 nt, Homo sapiens
cugcccuggcccgagggaccga

SEQ ID NO: 209580 - RNA, 21 nt, Homo sapiens
ccuggaaacacugagguugug

SEQ ID NO: 209581 - RNA, 22 nt, Homo sapiens
uauaccucaguuuuaucaggug

SEQ ID NO: 209582 - RNA, 22 nt, Homo sapiens
uggugguuuacaaaguaauuca

SEQ ID NO: 209583 - RNA, 22 nt, Homo sapiens
uggauuucuuugugaaucacca

SEQ ID NO: 209584 - RNA, 21 nt, Homo sapiens
uccucuucucccuccucccag

SEQ ID NO: 209585 - RNA, 20 nt, Homo sapiens
guagaggagauggcgcaggg

SEQ ID NO: 209586 - RNA, 22 nt, Homo sapiens
aggcagcgggguguaguggaua

SEQ ID NO: 209587 - RNA, 22 nt, Homo sapiens
uccauuacacuacccugccucu

SEQ ID NO: 209588 - RNA, 22 nt, Homo sapiens
gugaacgggcgccaucccgagg

SEQ ID NO: 209589 - RNA, 22 nt, Homo sapiens
gacugacaccucuuugggugaa

SEQ ID NO: 209590 - RNA, 21 nt, Homo sapiens
uacucaaaaagcugucaguca

SEQ ID NO: 209591 - RNA, 21 nt, Homo sapiens
uuaauaucggacaaccauugu

SEQ ID NO: 209592 - RNA, 21 nt, Homo sapiens
uacuuggaaaggcaucaguug

SEQ ID NO: 209593 - RNA, 22 nt, Homo sapiens
ugcaacgaaccugagccacuga

SEQ ID NO: 209594 - RNA, 22 nt, Homo sapiens
ugcaacuuaccugagucauuga

SEQ ID NO: 209595 - RNA, 21 nt, Homo sapiens
cacuguguccuuucugcguag

SEQ ID NO: 209596 - RNA, 22 nt, Homo sapiens
cacuggcuccuuucuggguaga

SEQ ID NO: 209597 - RNA, 22 nt, Homo sapiens
cacuguuuccuuucugagugga

SEQ ID NO: 209598 - RNA, 21 nt, Homo sapiens
uauucagaaaggugccaguca

SEQ ID NO: 209599 - RNA, 20 nt, Homo sapiens
ggggagcuguggaagcagua

SEQ ID NO: 209600 - RNA, 25 nt, Homo sapiens
cuagugagggacagaaccaggauuc

SEQ ID NO: 209601 - RNA, 23 nt, Homo sapiens
gcagcagagaauaggacuacguc

SEQ ID NO: 209602 - RNA, 20 nt, Homo sapiens
agagucuugugaugucuugc

SEQ ID NO: 209603 - RNA, 22 nt, Homo sapiens
ugugcgcagggagaccucuccc

SEQ ID NO: 209604 - RNA, 22 nt, Homo sapiens
ugucuacuacuggagacacugg

SEQ ID NO: 209605 - RNA, 23 nt, Homo sapiens
ccaguuaccgcuuccgcuaccgc

SEQ ID NO: 209606 - RNA, 22 nt, Homo sapiens
acaguagagggaggaaucgcag

SEQ ID NO: 209607 - RNA, 22 nt, Homo sapiens
auccgcgcucugacucucugcc

SEQ ID NO: 209608 - RNA, 20 nt, Homo sapiens
gugagucaggguggggcugg

SEQ ID NO: 209609 - RNA, 22 nt, Homo sapiens
ugcccuuaaaggugaacccagu

SEQ ID NO: 209610 - RNA, 21 nt, Homo sapiens
cccugggccucugcuccccag

SEQ ID NO: 209611 - RNA, 24 nt, Homo sapiens
uggggagcugaggcucugggggug

SEQ ID NO: 209612 - RNA, 21 nt, Homo sapiens
aaggcagggcccccgcucccc

SEQ ID NO: 209613 - RNA, 23 nt, Homo sapiens
cacccggcugugugcacaugugc

SEQ ID NO: 209614 - RNA, 22 nt, Homo sapiens
ucuucucuguuuuggccaugug

SEQ ID NO: 209615 - RNA, 21 nt, Homo sapiens
cugacuguugccguccuccag

SEQ ID NO: 209616 - RNA, 22 nt, Homo sapiens
aaauuauuguacaucggaugag

SEQ ID NO: 209617 - RNA, 21 nt, Homo sapiens
uugcucacuguucuucccuag

SEQ ID NO: 209618 - RNA, 18 nt, Homo sapiens
cagggucagcugagcaug

SEQ ID NO: 209619 - RNA, 21 nt, Homo sapiens
aagcauucuuucauugguugg

SEQ ID NO: 209620 - RNA, 22 nt, Homo sapiens
uuuccggcucgcgugggugugu

SEQ ID NO: 209621 - RNA, 21 nt, Homo sapiens
ccgucgccgccacccgagccg

SEQ ID NO: 209622 - RNA, 23 nt, Homo sapiens
gagggucuugggagggaugugac

SEQ ID NO: 209623 - RNA, 27 nt, Homo sapiens
cacuguaggugauggugagagugggca

SEQ ID NO: 209624 - RNA, 23 nt, Homo sapiens
ccugcagcgacuugauggcuucc

SEQ ID NO: 209625 - RNA, 22 nt, Homo sapiens
auauacagggggagacucuuau

SEQ ID NO: 209626 - RNA, 22 nt, Homo sapiens
auauacagggggagacucucau

SEQ ID NO: 209627 - RNA, 21 nt, Homo sapiens
agaggauacccuuuguauguu

SEQ ID NO: 209628 - RNA, 23 nt, Homo sapiens
gggaugguagaccggugacgugc

SEQ ID NO: 209629 - RNA, 21 nt, Homo sapiens
uaggacacauggucuacuucu

SEQ ID NO: 209630 - RNA, 22 nt, Homo sapiens
cuccugagccauucugagccuc

SEQ ID NO: 209631 - RNA, 21 nt, Homo sapiens
gugccagcugcagugggggag

SEQ ID NO: 209632 - RNA, 21 nt, Homo sapiens
cccggagccaggaugcagcuc

SEQ ID NO: 209633 - RNA, 21 nt, Homo sapiens
ucguggccuggucuccauuau

SEQ ID NO: 209634 - RNA, 20 nt, Homo sapiens
ucugcaggguuugcuuugag

SEQ ID NO: 209635 - RNA, 21 nt, Homo sapiens
uguucauguagauguuuaagc

SEQ ID NO: 209636 - RNA, 18 nt, Homo sapiens
ucagcuggcccucauuuc

SEQ ID NO: 209637 - RNA, 21 nt, Homo sapiens
uggcagggaggcugggagggg

SEQ ID NO: 209638 - RNA, 20 nt, Homo sapiens
ucacuguucagacaggcgga

SEQ ID NO: 209639 - RNA, 21 nt, Homo sapiens
ccccaccuccucucuccucag

SEQ ID NO: 209640 - RNA, 19 nt, Homo sapiens
gugaggacucgggaggugg

SEQ ID NO: 209641 - RNA, 22 nt, Homo sapiens
ugagccccugugccgcccccag

SEQ ID NO: 209642 - RNA, 22 nt, Homo sapiens
guggguacggcccagugggggg

SEQ ID NO: 209643 - RNA, 22 nt, Homo sapiens
ucaccagcccuguguucccuag

SEQ ID NO: 209644 - RNA, 26 nt, Homo sapiens
gugagggcaugcaggccuggaugggg

SEQ ID NO: 209645 - RNA, 20 nt, Homo sapiens
cgugccacccuuuuccccag

SEQ ID NO: 209646 - RNA, 17 nt, Homo sapiens
guggggccaggcggugg

SEQ ID NO: 209647 - RNA, 20 nt, Homo sapiens
ucacaccugccucgcccccc

SEQ ID NO: 209648 - RNA, 21 nt, Homo sapiens
gugggcgggggcaggugugug

SEQ ID NO: 209649 - RNA, 23 nt, Homo sapiens
cucucaccacugcccucccacag

SEQ ID NO: 209650 - RNA, 24 nt, Homo sapiens
guggguaggguuugggggagagcg

SEQ ID NO: 209651 - RNA, 20 nt, Homo sapiens
gugucugggcggacagcugc

SEQ ID NO: 209652 - RNA, 22 nt, Homo sapiens
agugggaggccagggcacggca

SEQ ID NO: 209653 - RNA, 20 nt, Homo sapiens
ugagcccuguccucccgcag

SEQ ID NO: 209654 - RNA, 22 nt, Homo sapiens
ucggccugaccacccaccccac

SEQ ID NO: 209655 - RNA, 21 nt, Homo sapiens
ggggggggggggggggggccg

SEQ ID NO: 209656 - RNA, 22 nt, Homo sapiens
ccucuuccccuugucucuccag

SEQ ID NO: 209657 - RNA, 22 nt, Homo sapiens
ugagugacaggggaaaugggga

SEQ ID NO: 209658 - RNA, 21 nt, Homo sapiens
uccuucugcuccgucccccag

SEQ ID NO: 209659 - RNA, 21 nt, Homo sapiens
cgggggcggggccgaagcgcg

SEQ ID NO: 209660 - RNA, 20 nt, Homo sapiens
cuuccucgucugucugcccc

SEQ ID NO: 209661 - RNA, 23 nt, Homo sapiens
gugagugggagccccagugugug

SEQ ID NO: 209662 - RNA, 22 nt, Homo sapiens
aacuggaucaauuauaggagug

SEQ ID NO: 209663 - RNA, 26 nt, Homo sapiens
aaguaguugguuuguaugagaugguu

SEQ ID NO: 209664 - RNA, 21 nt, Homo sapiens
aagugaucuaaaggccuacau

SEQ ID NO: 209665 - RNA, 22 nt, Homo sapiens
ucagaugaucuaaaggccuaua

SEQ ID NO: 209666 - RNA, 21 nt, Homo sapiens
uaggccuuuagaucacuuaaa

SEQ ID NO: 209667 - RNA, 19 nt, Homo sapiens
aauggauuuuuggagcagg

SEQ ID NO: 209668 - RNA, 24 nt, Homo sapiens
ccccgggaacgucgagacuggagc

SEQ ID NO: 209669 - RNA, 22 nt, Homo sapiens
acccgucccguucguccccgga

SEQ ID NO: 209670 - RNA, 27 nt, Homo sapiens
accuucuuguauaagcacugugcuaaa

SEQ ID NO: 209671 - RNA, 22 nt, Homo sapiens
acgcccuucccccccuucuuca

SEQ ID NO: 209672 - RNA, 21 nt, Homo sapiens
acggugcuggauguggccuuu

SEQ ID NO: 209673 - RNA, 21 nt, Homo sapiens
acucuagcugccaaaggcgcu

SEQ ID NO: 209674 - RNA, 22 nt, Homo sapiens
agaaggaaauugaauucauuua

SEQ ID NO: 209675 - RNA, 21 nt, Homo sapiens
agagaagaagaucagccugca

SEQ ID NO: 209676 - RNA, 24 nt, Homo sapiens
agccuggaagcuggagccugcagu

SEQ ID NO: 209677 - RNA, 23 nt, Homo sapiens
aggaugagcaaagaaaguagauu

SEQ ID NO: 209678 - RNA, 22 nt, Homo sapiens
aaccacuuucuuugcucaucca

SEQ ID NO: 209679 - RNA, 22 nt, Homo sapiens
cggaugagcaaagaaagugguu

SEQ ID NO: 209680 - RNA, 22 nt, Homo sapiens
aggcauugacuucucacuagcu

SEQ ID NO: 209681 - RNA, 21 nt, Homo sapiens
agugaaugauggguucugacc

SEQ ID NO: 209682 - RNA, 21 nt, Homo sapiens
aguuaggauuaggucguggaa

SEQ ID NO: 209683 - RNA, 18 nt, Homo sapiens
aucccaccucugccacca

SEQ ID NO: 209684 - RNA, 19 nt, Homo sapiens
aucccaccacugccaccau

SEQ ID NO: 209685 - RNA, 19 nt, Homo sapiens
auggauaaggcuuuggcuu

SEQ ID NO: 209686 - RNA, 22 nt, Homo sapiens
augggugaauuuguagaaggau

SEQ ID NO: 209687 - RNA, 22 nt, Homo sapiens
augguacccuggcauacugagu

SEQ ID NO: 209688 - RNA, 23 nt, Homo sapiens
caagucuuauuugagcaccuguu

SEQ ID NO: 209689 - RNA, 22 nt, Homo sapiens
caggauguggucaaguguuguu

SEQ ID NO: 209690 - RNA, 23 nt, Homo sapiens
ccucagggcuguagaacagggcu

SEQ ID NO: 209691 - RNA, 21 nt, Homo sapiens
ccuguugaaguguaaucccca

SEQ ID NO: 209692 - RNA, 18 nt, Homo sapiens
cgggcguggugguggggg

SEQ ID NO: 209693 - RNA, 20 nt, Homo sapiens
cgggcgugguggugggggug

SEQ ID NO: 209694 - RNA, 22 nt, Homo sapiens
cuggacugagccgugcuacugg

SEQ ID NO: 209695 - RNA, 22 nt, Homo sapiens
cuggacugagccaugcuacugg

SEQ ID NO: 209696 - RNA, 23 nt, Homo sapiens
cuggagauauggaagagcugugu

SEQ ID NO: 209697 - RNA, 22 nt, Homo sapiens
agugccugcuaugugccaggca

SEQ ID NO: 209698 - RNA, 22 nt, Homo sapiens
cuuggcaccuagcaagcacuca

SEQ ID NO: 209699 - RNA, 26 nt, Homo sapiens
gaugaugauggcagcaaauucugaaa

SEQ ID NO: 209700 - RNA, 25 nt, Homo sapiens
gggcgacaaagcaagacucuuucuu

SEQ ID NO: 209701 - RNA, 22 nt, Homo sapiens
ggcgacaaaacgagacccuguc

SEQ ID NO: 209702 - RNA, 25 nt, Homo sapiens
gaacccaugagguugaggcugcagu

SEQ ID NO: 209703 - RNA, 22 nt, Homo sapiens
uugcuugaacccaggaagugga

SEQ ID NO: 209704 - RNA, 19 nt, Homo sapiens
ggagauggagguugcagug

SEQ ID NO: 209705 - RNA, 21 nt, Homo sapiens
accacugcacuccagccugag

SEQ ID NO: 209706 - RNA, 22 nt, Homo sapiens
ggugguugaggcugcaguaagu

SEQ ID NO: 209707 - RNA, 17 nt, Homo sapiens
gugggggagaggcuguc

SEQ ID NO: 209708 - RNA, 20 nt, Homo sapiens
uaaagagcccuguggagaca

SEQ ID NO: 209709 - RNA, 22 nt, Homo sapiens
uacguagauauauauguauuuu

SEQ ID NO: 209710 - RNA, 24 nt, Homo sapiens
aaauauauauauauauguacguau

SEQ ID NO: 209711 - RNA, 22 nt, Homo sapiens
uaguacugugcauaucaucuau

SEQ ID NO: 209712 - RNA, 17 nt, Homo sapiens
ucauauugcuucuuucu

SEQ ID NO: 209713 - RNA, 17 nt, Homo sapiens
ucgccuccuccucuccc

SEQ ID NO: 209714 - RNA, 20 nt, Homo sapiens
ucguuugccuuuuucugcuu

SEQ ID NO: 209715 - RNA, 22 nt, Homo sapiens
ucuacaaaggaaagcgcuuucu

SEQ ID NO: 209716 - RNA, 22 nt, Homo sapiens
ucuauacagacccuggcuuuuc

SEQ ID NO: 209717 - RNA, 22 nt, Homo sapiens
ucugggcaacaaagugagaccu

SEQ ID NO: 209718 - RNA, 21 nt, Homo sapiens
gaucucacuuuguugcccagg

SEQ ID NO: 209719 - RNA, 21 nt, Homo sapiens
ugcaggaccaagaugagcccu

SEQ ID NO: 209720 - RNA, 22 nt, Homo sapiens
ugcuggaucagugguucgaguc

SEQ ID NO: 209721 - RNA, 21 nt, Homo sapiens
uggacugcccugaucuggaga

SEQ ID NO: 209722 - RNA, 23 nt, Homo sapiens
uggaguccaggaaucugcauuuu

SEQ ID NO: 209723 - RNA, 19 nt, Homo sapiens
uggauuuuuggaucaggga

SEQ ID NO: 209724 - RNA, 24 nt, Homo sapiens
uggcccugacugaagaccagcagu

SEQ ID NO: 209725 - RNA, 20 nt, Homo sapiens
ucgcgccccggcucccguuc

SEQ ID NO: 209726 - RNA, 25 nt, Homo sapiens
ugggaacggguuccggcagacgcug

SEQ ID NO: 209727 - RNA, 22 nt, Homo sapiens
uggguggucuggagauuugugc

SEQ ID NO: 209728 - RNA, 22 nt, Homo sapiens
ugugagguuggcauuguugucu

SEQ ID NO: 209729 - RNA, 21 nt, Homo sapiens
uuaggccgcagaucuggguga

SEQ ID NO: 209730 - RNA, 22 nt, Homo sapiens
aauaggccacggaucugggcaa

SEQ ID NO: 209731 - RNA, 21 nt, Homo sapiens
cacccagaucugcggccuaau

SEQ ID NO: 209732 - RNA, 22 nt, Homo sapiens
uuagggcccuggcuccaucucc

SEQ ID NO: 209733 - RNA, 17 nt, Homo sapiens
uucaaguaauucaggug

SEQ ID NO: 209734 - RNA, 22 nt, Homo sapiens
uucauucggcuguccagaugua

SEQ ID NO: 209735 - RNA, 22 nt, Homo sapiens
uucuggaauucugugugaggga

SEQ ID NO: 209736 - RNA, 24 nt, Homo sapiens
uugcagcugccugggagugacuuc

SEQ ID NO: 209737 - RNA, 21 nt, Homo sapiens
uugggacauacuuaugcuaaa

SEQ ID NO: 209738 - RNA, 22 nt, Homo sapiens
uuuagagacggggucuugcucu

SEQ ID NO: 209739 - RNA, 22 nt, Homo sapiens
ucucacuguagccucgaacccc

SEQ ID NO: 209740 - RNA, 22 nt, Homo sapiens
uuugaggcuacagugagaugug

SEQ ID NO: 209741 - RNA, 22 nt, Homo sapiens
uuuucaacucuaaugggagaga

SEQ ID NO: 209742 - RNA, 18 nt, Homo sapiens
acguuggcucugguggug

SEQ ID NO: 209743 - RNA, 22 nt, Homo sapiens
ccaccuccccugcaaacgucca

SEQ ID NO: 209744 - RNA, 22 nt, Homo sapiens
acucggcguggcgucggucgug

SEQ ID NO: 209745 - RNA, 21 nt, Homo sapiens
ucgaccggaccucgaccggcu

SEQ ID NO: 209746 - RNA, 18 nt, Homo sapiens
cagggaggugaaugugau

SEQ ID NO: 209747 - RNA, 19 nt, Homo sapiens
gaugaugcugcugaugcug

SEQ ID NO: 209748 - RNA, 22 nt, Homo sapiens
ucaaaacugaggggcauuuucu

SEQ ID NO: 209749 - RNA, 24 nt, Homo sapiens
ccagacagaauucuaugcacuuuc

SEQ ID NO: 209750 - RNA, 22 nt, Homo sapiens
cuccuggggcccgcacucucgc

SEQ ID NO: 209751 - RNA, 21 nt, Homo sapiens
cuccguuugccuguuucgcug

SEQ ID NO: 209752 - RNA, 22 nt, Homo sapiens
cucggcgcggggcgcgggcucc

SEQ ID NO: 209753 - RNA, 21 nt, Homo sapiens
gcccuccgcccgugcaccccg

SEQ ID NO: 209754 - RNA, 22 nt, Homo sapiens
gcccgcguguggagccaggugu

SEQ ID NO: 209755 - RNA, 22 nt, Homo sapiens
aaaaccgucuaguuacaguugu

SEQ ID NO: 209756 - RNA, 23 nt, Homo sapiens
cggcccgggcugcugcuguuccu

SEQ ID NO: 209757 - RNA, 21 nt, Homo sapiens
uccugcgcgucccagaugccc

SEQ ID NO: 209758 - RNA, 20 nt, Homo sapiens
uugggcugggcuggguuggg

SEQ ID NO: 209759 - RNA, 18 nt, Homo sapiens
uccagugcccuccucucc

SEQ ID NO: 209760 - RNA, 18 nt, Homo sapiens
ugaggcaguagauugaau

SEQ ID NO: 209761 - RNA, 21 nt, Homo sapiens
cggcggggacggcgauugguc

SEQ ID NO: 209762 - RNA, 22 nt, Homo sapiens
cgcaggggccgggugcucaccg

SEQ ID NO: 209763 - RNA, 21 nt, Homo sapiens
ugagugccggugccugcccug

SEQ ID NO: 209764 - RNA, 21 nt, Homo sapiens
ccaguccugugccugccgccu

SEQ ID NO: 209765 - RNA, 20 nt, Homo sapiens
caccaggcauuguggucucc

SEQ ID NO: 209766 - RNA, 23 nt, Homo sapiens
ugaguaccgccaugucuguuggg

SEQ ID NO: 209767 - RNA, 22 nt, Homo sapiens
uacccagagcaugcagugugaa

SEQ ID NO: 209768 - RNA, 22 nt, Homo sapiens
ucugcccccuccgcugcugcca

SEQ ID NO: 209769 - RNA, 22 nt, Homo sapiens
ggaggggucccgcacugggagg

SEQ ID NO: 209770 - RNA, 22 nt, Homo sapiens
cccugugcccggcccacuucug

SEQ ID NO: 209771 - RNA, 20 nt, Homo sapiens
ccccagggcgacgcggcggg

SEQ ID NO: 209772 - RNA, 22 nt, Homo sapiens
accuugccuugcugcccgggcc

SEQ ID NO: 209773 - RNA, 22 nt, Homo sapiens
ucaggccaggcacaguggcuca

SEQ ID NO: 209774 - RNA, 19 nt, Homo sapiens
accgugcaaagguagcaua

SEQ ID NO: 209775 - RNA, 20 nt, Homo sapiens
ccuccugcccuccuugcugu

SEQ ID NO: 209776 - RNA, 20 nt, Homo sapiens
uguuuugauaacaguaaugu

SEQ ID NO: 209777 - RNA, 23 nt, Homo sapiens
guguuaauuaaaccucuauuuac

SEQ ID NO: 209778 - RNA, 23 nt, Homo sapiens
cuguaauauaaauuuaauuuauu

SEQ ID NO: 209779 - RNA, 22 nt, Homo sapiens
uuggggaaacggccgcugagug

SEQ ID NO: 209780 - RNA, 21 nt, Homo sapiens
auuugugcuuggcucugucac

SEQ ID NO: 209781 - RNA, 21 nt, Homo sapiens
cgagccucaagcaagggacuu

SEQ ID NO: 209782 - RNA, 22 nt, Homo sapiens
uagucccuuccuugaagcgguc

SEQ ID NO: 209783 - RNA, 22 nt, Homo sapiens
caucagaauucauggaggcuag

SEQ ID NO: 209784 - RNA, 22 nt, Homo sapiens
agcuuccaugacuccugaugga

SEQ ID NO: 209785 - RNA, 21 nt, Homo sapiens
ccucccaugccaagaacuccc

SEQ ID NO: 209786 - RNA, 21 nt, Homo sapiens
gguucuuagcauaggaggucu

SEQ ID NO: 209787 - RNA, 21 nt, Homo sapiens
uguucucuuugccaaggacag

SEQ ID NO: 209788 - RNA, 22 nt, Homo sapiens
ucugcaagugucagaggcgagg

SEQ ID NO: 209789 - RNA, 21 nt, Homo sapiens
ugacagcgcccugccuggcuc

SEQ ID NO: 209790 - RNA, 24 nt, Homo sapiens
agcgcgggcugagcgcugccaguc

SEQ ID NO: 209791 - RNA, 22 nt, Homo sapiens
gagagcaguguguguugccugg

SEQ ID NO: 209792 - RNA, 22 nt, Homo sapiens
auuguccuugcuguuuggagau

SEQ ID NO: 209793 - RNA, 21 nt, Homo sapiens
auccccagauacaauggacaa

SEQ ID NO: 209794 - RNA, 20 nt, Homo sapiens
uaggaugggggugagaggug

SEQ ID NO: 209795 - RNA, 22 nt, Homo sapiens
agcagaggcagagaggcucagg

SEQ ID NO: 209796 - RNA, 23 nt, Homo sapiens
ugaggcucuguuagccuuggcuc

SEQ ID NO: 209797 - RNA, 22 nt, Homo sapiens
uaucauggaguugguaaagcac

SEQ ID NO: 209798 - RNA, 22 nt, Homo sapiens
guuuuaccaccuccaggagacu

SEQ ID NO: 209799 - RNA, 22 nt, Homo sapiens
cgccucuucagcgcugucuucc

SEQ ID NO: 209800 - RNA, 23 nt, Homo sapiens
caggcagugacuguucagacguc

SEQ ID NO: 209801 - RNA, 19 nt, Homo sapiens
ggggccuggcggugggcgg

SEQ ID NO: 209802 - RNA, 21 nt, Homo sapiens
guuagggccaacaucucuugg

SEQ ID NO: 209803 - RNA, 23 nt, Homo sapiens
agaauugcguuuggacaaucagu

SEQ ID NO: 209804 - RNA, 22 nt, Homo sapiens
agauguccagccacaauucucg

SEQ ID NO: 209805 - RNA, 23 nt, Homo sapiens
uugccacacugcaacaccuuaca

SEQ ID NO: 209806 - RNA, 21 nt, Homo sapiens
ucuggcuguuguggugugcaa

SEQ ID NO: 209807 - RNA, 23 nt, Homo sapiens
ucagcaccaggauauuguuggag

SEQ ID NO: 209808 - RNA, 23 nt, Homo sapiens
ucaacaaaaucacugaugcugga

SEQ ID NO: 209809 - RNA, 22 nt, Homo sapiens
gauaucagcucaguaggcaccg

SEQ ID NO: 209810 - RNA, 21 nt, Homo sapiens
guuccugcugaacugagccag

SEQ ID NO: 209811 - RNA, 20 nt, Homo sapiens
auauggguuuacuaguuggu

SEQ ID NO: 209812 - RNA, 22 nt, Homo sapiens
ugccuggaacauaguagggacu

SEQ ID NO: 209813 - RNA, 21 nt, Homo sapiens
auaggacucauauagugccag

SEQ ID NO: 209814 - RNA, 20 nt, Homo sapiens
agacacuauacgagucauau

SEQ ID NO: 209815 - RNA, 23 nt, Homo sapiens
ugugacugcauuaugaaaauucu

SEQ ID NO: 209816 - RNA, 20 nt, Homo sapiens
uggcuuuuaacuuugauggc

SEQ ID NO: 209817 - RNA, 21 nt, Homo sapiens
cacagcaaguguagacaggca

SEQ ID NO: 209818 - RNA, 21 nt, Homo sapiens
ccugucugugccugcuguaca

SEQ ID NO: 209819 - RNA, 22 nt, Homo sapiens
uaaauagaguaggcaaaggaca

SEQ ID NO: 209820 - RNA, 22 nt, Homo sapiens
uccuuugccuauucuauuuaag

SEQ ID NO: 209821 - RNA, 22 nt, Homo sapiens
guugggacaagaggacggucuu

SEQ ID NO: 209822 - RNA, 17 nt, Homo sapiens
cagagaauuguuuaauc

SEQ ID NO: 209823 - RNA, 22 nt, Homo sapiens
acuuuccucacucccgugaagu

SEQ ID NO: 209824 - RNA, 21 nt, Homo sapiens
uucgcgggcgaaggcaaaguc

SEQ ID NO: 209825 - RNA, 20 nt, Homo sapiens
uagaggaagcuguggagaga

SEQ ID NO: 209826 - RNA, 22 nt, Homo sapiens
caucuggcauccgucacacaga

SEQ ID NO: 209827 - RNA, 22 nt, Homo sapiens
ugagggacagaugccagaagca

SEQ ID NO: 209828 - RNA, 22 nt, Homo sapiens
uccccuucugcaggccugcugg

SEQ ID NO: 209829 - RNA, 23 nt, Homo sapiens
aucagggcuuguggaaugggaag

SEQ ID NO: 209830 - RNA, 23 nt, Homo sapiens
ucuggcaaguaaaaaacucucau

SEQ ID NO: 209831 - RNA, 22 nt, Homo sapiens
aaacuaaucucuacacugcugc

SEQ ID NO: 209832 - RNA, 22 nt, Homo sapiens
gcaguaguguagagauugguuu

SEQ ID NO: 209833 - RNA, 21 nt, Homo sapiens
gcugcaccggagacuggguaa

SEQ ID NO: 209834 - RNA, 21 nt, Homo sapiens
uacccagucuccggugcagcc

SEQ ID NO: 209835 - RNA, 23 nt, Homo sapiens
ucgaggacugguggaagggccuu

SEQ ID NO: 209836 - RNA, 24 nt, Homo sapiens
uggguagagaaggagcucagagga

SEQ ID NO: 209837 - RNA, 22 nt, Homo sapiens
uaaagaacucuuaaaacccaau

SEQ ID NO: 209838 - RNA, 23 nt, Homo sapiens
ugauggauaaaagacuacauauu

SEQ ID NO: 209839 - RNA, 22 nt, Homo sapiens
ugccuaggcugagacugcagug

SEQ ID NO: 209840 - RNA, 22 nt, Homo sapiens
ggcuggagcgagugcaguggug

SEQ ID NO: 209841 - RNA, 22 nt, Homo sapiens
uggcccaaccuauucaguuagu

SEQ ID NO: 209842 - RNA, 23 nt, Homo sapiens
cugacugaauagguagggucauu

SEQ ID NO: 209843 - RNA, 24 nt, Homo sapiens
ucuguagccugggagcaauggggu

SEQ ID NO: 209844 - RNA, 24 nt, Homo sapiens
uguggacagugagguagagggagu

SEQ ID NO: 209845 - RNA, 23 nt, Homo sapiens
uaggagcucaacagaugccuguu

SEQ ID NO: 209846 - RNA, 22 nt, Homo sapiens
agcuuuugggaauucagguagu

SEQ ID NO: 209847 - RNA, 21 nt, Homo sapiens
accugaauuaccaaaagcuuu

SEQ ID NO: 209848 - RNA, 19 nt, Homo sapiens
gagggcggguggaggagga

SEQ ID NO: 209849 - RNA, 22 nt, Homo sapiens
aaggccuuucugaaccuucaga

SEQ ID NO: 209850 - RNA, 25 nt, Homo sapiens
auaacauuguaaagcgcuucuuucg

SEQ ID NO: 209851 - RNA, 22 nt, Homo sapiens
auauaccuguucggucucuuua

SEQ ID NO: 209852 - RNA, 22 nt, Homo sapiens
aggggaccaaagagauauauag

SEQ ID NO: 209853 - RNA, 24 nt, Homo sapiens
agauauuuugaguguuuggaauug

SEQ ID NO: 209854 - RNA, 22 nt, Homo sapiens
aacuccaaacacucaaaacuca

SEQ ID NO: 209855 - RNA, 22 nt, Homo sapiens
caugcuaggauagaaagaaugg

SEQ ID NO: 209856 - RNA, 24 nt, Homo sapiens
gguugggcagugaggaggguguga

SEQ ID NO: 209857 - RNA, 22 nt, Homo sapiens
uggaaaaaacuggugugugcuu

SEQ ID NO: 209858 - RNA, 23 nt, Homo sapiens
uuuguauggauauguguguguau

SEQ ID NO: 209859 - RNA, 22 nt, Homo sapiens
cuggggagauccucgagguugg

SEQ ID NO: 209860 - RNA, 22 nt, Homo sapiens
caaccucgacgaucuccucagc

SEQ ID NO: 209861 - RNA, 21 nt, Homo sapiens
ugaggagaucgucgagguugg

SEQ ID NO: 209862 - RNA, 22 nt, Homo sapiens
caaccucgaggaucuccccagc

SEQ ID NO: 209863 - RNA, 21 nt, Homo sapiens
gguggggcaaugggaucaggu

SEQ ID NO: 209864 - RNA, 22 nt, Homo sapiens
uguguuagaauaggggcaauaa

SEQ ID NO: 209865 - RNA, 22 nt, Homo sapiens
auugccucuguucuaacacaag

SEQ ID NO: 209866 - RNA, 23 nt, Homo sapiens
ggggaaagcgaguagggacauuu

SEQ ID NO: 209867 - RNA, 22 nt, Homo sapiens
cagaaggggaguugggagcaga

SEQ ID NO: 209868 - RNA, 21 nt, Homo sapiens
ccaggcucugcagugggaacu

SEQ ID NO: 209869 - RNA, 18 nt, Homo sapiens
ccaggcucugcaguggga

SEQ ID NO: 209870 - RNA, 21 nt, Homo sapiens
cucccacuuccagaucuuucu

SEQ ID NO: 209871 - RNA, 22 nt, Homo sapiens
aaagaucuggaagugggagaca

SEQ ID NO: 209872 - RNA, 22 nt, Homo sapiens
cugcccuagucuagcugaagcu

SEQ ID NO: 209873 - RNA, 22 nt, Homo sapiens
uucagccaggcuagugcagucu

SEQ ID NO: 209874 - RNA, 22 nt, Homo sapiens
aagggcuuccucucugcaggac

SEQ ID NO: 209875 - RNA, 21 nt, Homo sapiens
ccugcagagaggaagcccuuc

SEQ ID NO: 209876 - RNA, 22 nt, Homo sapiens
uaggauuacaagugucggccac

SEQ ID NO: 209877 - RNA, 22 nt, Homo sapiens
agagcugagacuagaaagccca

SEQ ID NO: 209878 - RNA, 22 nt, Homo sapiens
ggcuuucuagucucagcucucc

SEQ ID NO: 209879 - RNA, 23 nt, Homo sapiens
cugauaagaacagaggcccagau

SEQ ID NO: 209880 - RNA, 21 nt, Homo sapiens
ucccuaccccuccacucccca

SEQ ID NO: 209881 - RNA, 23 nt, Homo sapiens
uuagggaguagaaggguggggag

SEQ ID NO: 209882 - RNA, 22 nt, Homo sapiens
uauaaaaugagggcaguaagac

SEQ ID NO: 209883 - RNA, 22 nt, Homo sapiens
ugugacuuuaagggaaauggcg

SEQ ID NO: 209884 - RNA, 22 nt, Homo sapiens
agguggaugcaaugugaccuca

SEQ ID NO: 209885 - RNA, 23 nt, Homo sapiens
cgcagacaaugccuacuggccua

SEQ ID NO: 209886 - RNA, 22 nt, Homo sapiens
aggauuucagaaauacuggugu

SEQ ID NO: 209887 - RNA, 17 nt, Homo sapiens
gaguucuacagucagac

SEQ ID NO: 209888 - RNA, 22 nt, Homo sapiens
uaggacugugcuuggcacauag

SEQ ID NO: 209889 - RNA, 22 nt, Homo sapiens
cugggguucugagacagacagu

SEQ ID NO: 209890 - RNA, 24 nt, Homo sapiens
agauguauggaaucuguauauauc

SEQ ID NO: 209891 - RNA, 22 nt, Homo sapiens
aaaggaggaaauaggcaggcca

SEQ ID NO: 209892 - RNA, 22 nt, Homo sapiens
ugcccugccuguuuucuccuuu

SEQ ID NO: 209893 - RNA, 23 nt, Homo sapiens
uagugaguuagagaugcagagcc

SEQ ID NO: 209894 - RNA, 22 nt, Homo sapiens
cggggagagaacgcagugacgu

SEQ ID NO: 209895 - RNA, 19 nt, Homo sapiens
acuggccugggacuaccgg

SEQ ID NO: 209896 - RNA, 21 nt, Homo sapiens
ugcacggcacuggggacacgu

SEQ ID NO: 209897 - RNA, 23 nt, Homo sapiens
uguguacacacgugccaggcgcu

SEQ ID NO: 209898 - RNA, 17 nt, Homo sapiens
ggggcgcggccggaucg

SEQ ID NO: 209899 - RNA, 22 nt, Homo sapiens
agaaggggugaaauuuaaacgu

SEQ ID NO: 209900 - RNA, 19 nt, Homo sapiens
uggggcggagcuuccggag

SEQ ID NO: 209901 - RNA, 22 nt, Homo sapiens
uggggcggagcuuccggaggcc

SEQ ID NO: 209902 - RNA, 25 nt, Homo sapiens
cuuccagacgcuccgccccacgucg

SEQ ID NO: 209903 - RNA, 19 nt, Homo sapiens
aucgggcccucggcgccgg

SEQ ID NO: 209904 - RNA, 17 nt, Homo sapiens
gcuucuguaguguaguc

SEQ ID NO: 209905 - RNA, 22 nt, Homo sapiens
gccucucucggagucgcucgga

SEQ ID NO: 209906 - RNA, 23 nt, Homo sapiens
aaagucucgcucucugccccuca

SEQ ID NO: 209907 - RNA, 24 nt, Homo sapiens
ugaggggccucagaccgagcuuuu

SEQ ID NO: 209908 - RNA, 23 nt, Homo sapiens
agaagaaggcggucggucugcgg

SEQ ID NO: 209909 - RNA, 21 nt, Homo sapiens
ucacgcggagagauggcuuug

SEQ ID NO: 209910 - RNA, 22 nt, Homo sapiens
caggcgucugucuacguggcuu

SEQ ID NO: 209911 - RNA, 20 nt, Homo sapiens
uuggccauggggcugcgcgg

SEQ ID NO: 209912 - RNA, 23 nt, Homo sapiens
ccugggcagcguguggcugaagg

SEQ ID NO: 209913 - RNA, 23 nt, Homo sapiens
agaggcuuugugcggauacgggg

SEQ ID NO: 209914 - RNA, 21 nt, Homo sapiens
cccuugggucugaugggguag

SEQ ID NO: 209915 - RNA, 25 nt, Homo sapiens
ugccccaucugugcccuggguagga

SEQ ID NO: 209916 - RNA, 23 nt, Homo sapiens
uguggaagguagacggccagaga

SEQ ID NO: 209917 - RNA, 20 nt, Homo sapiens
ucuggccagcuacgucccca

SEQ ID NO: 209918 - RNA, 23 nt, Homo sapiens
uggggacguagcuggccagacag

SEQ ID NO: 209919 - RNA, 22 nt, Homo sapiens
cucucuggccgucuaccuucca

SEQ ID NO: 209920 - RNA, 23 nt, Homo sapiens
ucugggagguuguagcaguggaa

SEQ ID NO: 209921 - RNA, 22 nt, Homo sapiens
uccugcguaggaucugaggagu

SEQ ID NO: 209922 - RNA, 22 nt, Homo sapiens
agcucugcugcucacuggcagu

SEQ ID NO: 209923 - RNA, 21 nt, Homo sapiens
ggccagccaccaggagggcug

SEQ ID NO: 209924 - RNA, 17 nt, Homo sapiens
cgcgccgggcccggguu

SEQ ID NO: 209925 - RNA, 18 nt, Homo sapiens
cggggcggcaggggccuc

SEQ ID NO: 209926 - RNA, 23 nt, Homo sapiens
ggaggcgcaggcucggaaaggcg

SEQ ID NO: 209927 - RNA, 22 nt, Homo sapiens
guggaguccuggggaauggaga

SEQ ID NO: 209928 - RNA, 23 nt, Homo sapiens
agggacugccuuaggagaaaguu

SEQ ID NO: 209929 - RNA, 22 nt, Homo sapiens
caccuugcgcuacucaggucug

SEQ ID NO: 209930 - RNA, 22 nt, Homo sapiens
aaucugagaaggcgcacaaggu

SEQ ID NO: 209931 - RNA, 17 nt, Homo sapiens
gggauaugaagaaaaau

SEQ ID NO: 209932 - RNA, 22 nt, Homo sapiens
uggaagggagaagagcuuuaau

SEQ ID NO: 209933 - RNA, 24 nt, Homo sapiens
aacaacaaaaucacuagucuucca

SEQ ID NO: 209934 - RNA, 22 nt, Homo sapiens
agguagacugggauuuguuguu

SEQ ID NO: 209935 - RNA, 22 nt, Homo sapiens
aaacaccauugucacacuccac

SEQ ID NO: 209936 - RNA, 23 nt, Homo sapiens
uuuagugugauaauggcguuuga

SEQ ID NO: 209937 - RNA, 23 nt, Homo sapiens
ccuccguguuaccuguccucuag

SEQ ID NO: 209938 - RNA, 23 nt, Homo sapiens
ugaggauggauagcaaggaagcc

SEQ ID NO: 209939 - RNA, 21 nt, Homo sapiens
aaaauuucuuucacuacuuag

SEQ ID NO: 209940 - RNA, 21 nt, Homo sapiens
uuagugaaggcuauuuuaauu

SEQ ID NO: 209941 - RNA, 20 nt, Homo sapiens
acuguaaacgcuuucugaug

SEQ ID NO: 209942 - RNA, 22 nt, Homo sapiens
gcaugugaugaagcaaaucagu

SEQ ID NO: 209943 - RNA, 24 nt, Homo sapiens
caaagugaugaguaauacuggcug

SEQ ID NO: 209944 - RNA, 20 nt, Homo sapiens
gaaucggaaaggaggcgccg

SEQ ID NO: 209945 - RNA, 21 nt, Homo sapiens
uugugaagaaagaaauucuua

SEQ ID NO: 209946 - RNA, 22 nt, Homo sapiens
aggaggcaucuugagaaaugga

SEQ ID NO: 209947 - RNA, 24 nt, Homo sapiens
acaaaaaaaaaagcccaacccuuc

SEQ ID NO: 209948 - RNA, 22 nt, Homo sapiens
uguuguacuuuuuuuuuuguuc

SEQ ID NO: 209949 - RNA, 23 nt, Homo sapiens
uagccuucagaucuugguguuuu

SEQ ID NO: 209950 - RNA, 23 nt, Homo sapiens
ccacuuggaucugaaggcugccc

SEQ ID NO: 209951 - RNA, 21 nt, Homo sapiens
ucucucggcuccucgcggcuc

SEQ ID NO: 209952 - RNA, 23 nt, Homo sapiens
cgagggcauuucaugaugcaggc

SEQ ID NO: 209953 - RNA, 22 nt, Homo sapiens
augaagugcacucaugauaugu

SEQ ID NO: 209954 - RNA, 23 nt, Homo sapiens
caucagcacccuauguccuuucu

SEQ ID NO: 209955 - RNA, 22 nt, Homo sapiens
aaagacauaguugcaagauggg

SEQ ID NO: 209956 - RNA, 22 nt, Homo sapiens
ugucuacauuaaugaaaagagc

SEQ ID NO: 209957 - RNA, 22 nt, Homo sapiens
gggaccauccugccugcugugg

SEQ ID NO: 209958 - RNA, 22 nt, Homo sapiens
ucagcaggcaggcuggugcagc

SEQ ID NO: 209959 - RNA, 22 nt, Homo sapiens
ucacccugcaucccgcacccag

SEQ ID NO: 209960 - RNA, 22 nt, Homo sapiens
gugggcugggcugggcugggcc

SEQ ID NO: 209961 - RNA, 20 nt, Homo sapiens
cgcgggucggggucugcagg

SEQ ID NO: 209962 - RNA, 22 nt, Homo sapiens
ucaccugaccucccaugccugu

SEQ ID NO: 209963 - RNA, 22 nt, Homo sapiens
caggcacgggagcucaggugag

SEQ ID NO: 209964 - RNA, 21 nt, Homo sapiens
ucaccugagcucccgugccug

SEQ ID NO: 209965 - RNA, 20 nt, Homo sapiens
aggcaugggaggucagguga

SEQ ID NO: 209966 - RNA, 22 nt, Homo sapiens
aaaaugaaaugagcccagccca

SEQ ID NO: 209967 - RNA, 21 nt, Homo sapiens
agccgcggggaucgccgaggg

SEQ ID NO: 209968 - RNA, 19 nt, Homo sapiens
agggaccugagugucuaag

SEQ ID NO: 209969 - RNA, 19 nt, Homo sapiens
aggugugucuguagagucc

SEQ ID NO: 209970 - RNA, 24 nt, Homo sapiens
cauagcccggucgcugguacauga

SEQ ID NO: 209971 - RNA, 18 nt, Homo sapiens
cggcuggaggugugagga

SEQ ID NO: 209972 - RNA, 18 nt, Homo sapiens
cuaagaaguugacugaag

SEQ ID NO: 209973 - RNA, 19 nt, Homo sapiens
gacuggacaagcugaggaa

SEQ ID NO: 209974 - RNA, 21 nt, Homo sapiens
gcuugucgcugcgguguugcu

SEQ ID NO: 209975 - RNA, 17 nt, Homo sapiens
ggcgggugcgggggugg

SEQ ID NO: 209976 - RNA, 21 nt, Homo sapiens
ugugucccauuauuggugauu

SEQ ID NO: 209977 - RNA, 22 nt, Homo sapiens
uuuaagaaaacaccauggagau

SEQ ID NO: 209978 - RNA, 21 nt, Homo sapiens
ugaguguugucuacgagggca

SEQ ID NO: 209979 - RNA, 21 nt, Homo sapiens
acugacaggagagcauuuuga

SEQ ID NO: 209980 - RNA, 22 nt, Homo sapiens
ugaccugggacucggacagcug

SEQ ID NO: 209981 - RNA, 24 nt, Homo sapiens
gaaaaugaugaguagugacugaug

SEQ ID NO: 209982 - RNA, 23 nt, Homo sapiens
ugagcaccacacaggccgggcgc

SEQ ID NO: 209983 - RNA, 21 nt, Homo sapiens
gcuggucugcguggugcucgg

SEQ ID NO: 209984 - RNA, 22 nt, Homo sapiens
ucucaggaguaaagacagaguu

SEQ ID NO: 209985 - RNA, 22 nt, Homo sapiens
aacucugucuucacucaugagu

SEQ ID NO: 209986 - RNA, 18 nt, Homo sapiens
agcaggugcggggcggcg

SEQ ID NO: 209987 - RNA, 21 nt, Homo sapiens
cagugcaaguguagaugccga

SEQ ID NO: 209988 - RNA, 22 nt, Homo sapiens
accuuccucuccaugggucuuu

SEQ ID NO: 209989 - RNA, 22 nt, Homo sapiens
aaagacccauugaggagaaggu

SEQ ID NO: 209990 - RNA, 21 nt, Homo sapiens
aauguagagauugaucaaaau

SEQ ID NO: 209991 - RNA, 23 nt, Homo sapiens
acggaauauguauacggaauaua

SEQ ID NO: 209992 - RNA, 24 nt, Homo sapiens
agagcucacagcuguccuucucua

SEQ ID NO: 209993 - RNA, 22 nt, Homo sapiens
aucaaauaaggacuagucugca

SEQ ID NO: 209994 - RNA, 23 nt, Homo sapiens
augagacucauguaaaacaucuu

SEQ ID NO: 209995 - RNA, 21 nt, Homo sapiens
auggaauguauauacggaaua

SEQ ID NO: 209996 - RNA, 22 nt, Homo sapiens
auuguagaaccuaagauuggcc

SEQ ID NO: 209997 - RNA, 22 nt, Homo sapiens
caucucuaaggaacucccccaa

SEQ ID NO: 209998 - RNA, 23 nt, Homo sapiens
uauggggcuucuguagagauuuc

SEQ ID NO: 209999 - RNA, 20 nt, Homo sapiens
ccguguuucccccacgcuuu

SEQ ID NO: 210000 - RNA, 15 nt, Homo sapiens
aggagauccuggguu

SEQ ID NO: 210001 - RNA, 22 nt, Homo sapiens
cucgugggcucuggccacggcc

SEQ ID NO: 210002 - RNA, 22 nt, Homo sapiens
caguggccagagcccugcagug

SEQ ID NO: 210003 - RNA, 22 nt, Homo sapiens
cugcagaguuuguacggaccgg

SEQ ID NO: 210004 - RNA, 20 nt, Homo sapiens
uccguacaaacucugcugug

SEQ ID NO: 210005 - RNA, 22 nt, Homo sapiens
cuuccccccaguaaucuucauc

SEQ ID NO: 210006 - RNA, 23 nt, Homo sapiens
ugaggauauggcagggaagggga

SEQ ID NO: 210007 - RNA, 23 nt, Homo sapiens
uuuugcaugacccugggaguagg

SEQ ID NO: 210008 - RNA, 22 nt, Homo sapiens
gacucacucacaggauugugca

SEQ ID NO: 210009 - RNA, 22 nt, Homo sapiens
acacagugcuucauccacuacu

SEQ ID NO: 210010 - RNA, 22 nt, Homo sapiens
uaguggaugaugcacucugugc

SEQ ID NO: 210011 - RNA, 21 nt, Homo sapiens
ugaugauacagguggagguag

SEQ ID NO: 210012 - RNA, 22 nt, Homo sapiens
cuacuucuaccuguguuaucau

SEQ ID NO: 210013 - RNA, 22 nt, Homo sapiens
ugcgacauuggaaguaguauca

SEQ ID NO: 210014 - RNA, 21 nt, Homo sapiens
uuagaccuaguacacguccuu

SEQ ID NO: 210015 - RNA, 22 nt, Homo sapiens
uuuccuacccuaccugaagacu

SEQ ID NO: 210016 - RNA, 22 nt, Homo sapiens
aucuguaagagaaaguaaauga

SEQ ID NO: 210017 - RNA, 24 nt, Homo sapiens
cccggacaggcguucgugcgacgu

SEQ ID NO: 210018 - RNA, 22 nt, Homo sapiens
uauggaaagacuuugccacucu

SEQ ID NO: 210019 - RNA, 21 nt, Homo sapiens
aguggcaaagucuuuccauau

SEQ ID NO: 210020 - RNA, 22 nt, Homo sapiens
cugggaggugugauaucguggu

SEQ ID NO: 210021 - RNA, 22 nt, Homo sapiens
ugugauaucaugguuccuggga

SEQ ID NO: 210022 - RNA, 22 nt, Homo sapiens
cugggaggugugauauuguggu

SEQ ID NO: 210023 - RNA, 22 nt, Homo sapiens
ugugauaucaugguuccuggga

SEQ ID NO: 210024 - RNA, 22 nt, Homo sapiens
cugggaggugugauauuguggu

SEQ ID NO: 210025 - RNA, 22 nt, Homo sapiens
gggaggugugaucucacacucg

SEQ ID NO: 210026 - RNA, 22 nt, Homo sapiens
ugugauaucaugguuccuggga

SEQ ID NO: 210027 - RNA, 22 nt, Homo sapiens
ugugauaucgugcuuccuggga

SEQ ID NO: 210028 - RNA, 23 nt, Homo sapiens
accuggacccagcguagacaaag

SEQ ID NO: 210029 - RNA, 22 nt, Homo sapiens
accaagucugcgucauccucuc

SEQ ID NO: 210030 - RNA, 23 nt, Homo sapiens
aguggaugauggagacucgguac

SEQ ID NO: 210031 - RNA, 24 nt, Homo sapiens
guuccacacugacacugcagaagu

SEQ ID NO: 210032 - RNA, 24 nt, Homo sapiens
ccugcuggucaggaguggauacug

SEQ ID NO: 210033 - RNA, 20 nt, Homo sapiens
gguauccguuuggggauggu

SEQ ID NO: 210034 - RNA, 22 nt, Homo sapiens
gaaggcagcagugcuccccugu

SEQ ID NO: 210035 - RNA, 22 nt, Homo sapiens
aggugcuccaggcuggcucaca

SEQ ID NO: 210036 - RNA, 22 nt, Homo sapiens
gagcaauguagguagacuguuu

SEQ ID NO: 210037 - RNA, 22 nt, Homo sapiens
uguccucuagggccugcagucu

SEQ ID NO: 210038 - RNA, 20 nt, Homo sapiens
aaaggcauaaaaccaagaca

SEQ ID NO: 210039 - RNA, 22 nt, Homo sapiens
uguguggauccuggaggaggca

SEQ ID NO: 210040 - RNA, 21 nt, Homo sapiens
uaacgcauaauauggacaugu

SEQ ID NO: 210041 - RNA, 22 nt, Homo sapiens
agacaucaagaucagucccaaa

SEQ ID NO: 210042 - RNA, 22 nt, Homo sapiens
uuugggacugaucuugaugucu

SEQ ID NO: 210043 - RNA, 22 nt, Homo sapiens
aaggaaccagaaaaugagaagu

SEQ ID NO: 210044 - RNA, 22 nt, Homo sapiens
uugaggaaaagauggucuuauu

SEQ ID NO: 210045 - RNA, 26 nt, Homo sapiens
aagaggaagaaauggcugguucucag

SEQ ID NO: 210046 - RNA, 20 nt, Homo sapiens
gcucggacugagcagguggg

SEQ ID NO: 210047 - RNA, 21 nt, Homo sapiens
acagggccgcagauggagacu

SEQ ID NO: 210048 - RNA, 21 nt, Homo sapiens
gcagagaacaaaggacucagu

SEQ ID NO: 210049 - RNA, 22 nt, Homo sapiens
acugauuaucuuaacucucuga

SEQ ID NO: 210050 - RNA, 23 nt, Homo sapiens
ucucugaguaccauaugccuugu

SEQ ID NO: 210051 - RNA, 22 nt, Homo sapiens
ucuggccuugacuugacucuuu

SEQ ID NO: 210052 - RNA, 23 nt, Homo sapiens
ucaaggccagaggucccacagca

SEQ ID NO: 210053 - RNA, 22 nt, Homo sapiens
aacuaguaauguuggauuaggg

SEQ ID NO: 210054 - RNA, 22 nt, Homo sapiens
auauguauaugugacugcuacu

SEQ ID NO: 210055 - RNA, 21 nt, Homo sapiens
acuccaguuuuaguucucuug

SEQ ID NO: 210056 - RNA, 22 nt, Homo sapiens
aagagaacugaaaguggagccu

SEQ ID NO: 210057 - RNA, 21 nt, Homo sapiens
uggccaaaaagcaggcagaga

SEQ ID NO: 210058 - RNA, 22 nt, Homo sapiens
cagguagauauuugauaggcau

SEQ ID NO: 210059 - RNA, 21 nt, Homo sapiens
gccuaucacauaucugccugu

SEQ ID NO: 210060 - RNA, 22 nt, Homo sapiens
ggaggaaccuuggagcuucggc

SEQ ID NO: 210061 - RNA, 23 nt, Homo sapiens
gaggcugaugugaguagaccacu

SEQ ID NO: 210062 - RNA, 22 nt, Homo sapiens
ugcucagguugcacagcuggga

SEQ ID NO: 210063 - RNA, 22 nt, Homo sapiens
ucagguguggaaacugaggcag

SEQ ID NO: 210064 - RNA, 22 nt, Homo sapiens
uguagauacgagcaccagccac

SEQ ID NO: 210065 - RNA, 22 nt, Homo sapiens
uaagggguguauggcagaugca

SEQ ID NO: 210066 - RNA, 23 nt, Homo sapiens
acaggcggcuguagcaauggggg

SEQ ID NO: 210067 - RNA, 22 nt, Homo sapiens
aauucccuuguagauaacccgg

SEQ ID NO: 210068 - RNA, 22 nt, Homo sapiens
uacgcgcagaccacaggauguc

SEQ ID NO: 210069 - RNA, 22 nt, Homo sapiens
cagcccggaucccagcccacuu

SEQ ID NO: 210070 - RNA, 20 nt, Homo sapiens
guggguuggggcgggcucug

SEQ ID NO: 210071 - RNA, 22 nt, Homo sapiens
uuacacacaacugaggaucaua

SEQ ID NO: 210072 - RNA, 21 nt, Homo sapiens
uuucagauaacaguauuacau

SEQ ID NO: 210073 - RNA, 22 nt, Homo sapiens
aagcaauacuguuaccugaaau

SEQ ID NO: 210074 - RNA, 23 nt, Homo sapiens
uagcccccaggcuucacuuggcg

SEQ ID NO: 210075 - RNA, 23 nt, Homo sapiens
uucgggcuggccugcugcuccgg

SEQ ID NO: 210076 - RNA, 21 nt, Homo sapiens
ugugcagcaggccaaccgaga

SEQ ID NO: 210077 - RNA, 23 nt, Homo sapiens
agggcauaggagaggguugauau

SEQ ID NO: 210078 - RNA, 20 nt, Homo sapiens
ggcggcggcggaggcggggg

SEQ ID NO: 210079 - RNA, 22 nt, Homo sapiens
cugccagccccguuccagggca

SEQ ID NO: 210080 - RNA, 23 nt, Homo sapiens
acaaaguacagcauuagccuuag

SEQ ID NO: 210081 - RNA, 23 nt, Homo sapiens
aaaggucauuguaagguuaaugc

SEQ ID NO: 210082 - RNA, 22 nt, Homo sapiens
ugaggcuaaugcacuacuucac

SEQ ID NO: 210083 - RNA, 24 nt, Homo sapiens
uauagagagcaggaagauuaaugu

SEQ ID NO: 210084 - RNA, 23 nt, Homo sapiens
gugcuucaucguaauuaaccuua

SEQ ID NO: 210085 - RNA, 24 nt, Homo sapiens
guggaaagcaugcauccagggugu

SEQ ID NO: 210086 - RNA, 17 nt, Homo sapiens
ccugagaaaagggccaa

SEQ ID NO: 210087 - RNA, 19 nt, Homo sapiens
ggccacugagucagcacca

SEQ ID NO: 210088 - RNA, 18 nt, Homo sapiens
agggcauguccagggggu

SEQ ID NO: 210089 - RNA, 23 nt, Homo sapiens
gccuggagcuacuccaccaucuc

SEQ ID NO: 210090 - RNA, 17 nt, Homo sapiens
caguguucagagaugga

SEQ ID NO: 210091 - RNA, 18 nt, Homo sapiens
aucugaccugaugaaggu

SEQ ID NO: 210092 - RNA, 18 nt, Homo sapiens
ccagagguggggacugag

SEQ ID NO: 210093 - RNA, 17 nt, Homo sapiens
ccccgccaccgccuugg

SEQ ID NO: 210094 - RNA, 22 nt, Homo sapiens
caguugggucuaggggucagga

SEQ ID NO: 210095 - RNA, 19 nt, Homo sapiens
cuuggggcauggaguccca

SEQ ID NO: 210096 - RNA, 16 nt, Homo sapiens
aggaaacagggaccca

SEQ ID NO: 210097 - RNA, 17 nt, Homo sapiens
gacauucagacuaccug

SEQ ID NO: 210098 - RNA, 18 nt, Homo sapiens
auucuaagugccuuggcc

SEQ ID NO: 210099 - RNA, 17 nt, Homo sapiens
acucagucauggucauu

SEQ ID NO: 210100 - RNA, 19 nt, Homo sapiens
cugugggcucagcucuggg

SEQ ID NO: 210101 - RNA, 16 nt, Homo sapiens
cuaggaggccuuggcc

SEQ ID NO: 210102 - RNA, 16 nt, Homo sapiens
uccagcucgguggcac

SEQ ID NO: 210103 - RNA, 21 nt, Homo sapiens
ggcuccuccucucaggaugug

SEQ ID NO: 210104 - RNA, 21 nt, Homo sapiens
gcaggcacagacagcccuggc

SEQ ID NO: 210105 - RNA, 20 nt, Homo sapiens
ucagggagucaggggagggc

SEQ ID NO: 210106 - RNA, 19 nt, Homo sapiens
gggggaagaaaaggugggg

SEQ ID NO: 210107 - RNA, 18 nt, Homo sapiens
cauucaacuagugauugu

SEQ ID NO: 210108 - RNA, 18 nt, Homo sapiens
guguucucugauggacag

SEQ ID NO: 210109 - RNA, 18 nt, Homo sapiens
cagcagucccucccccug

SEQ ID NO: 210110 - RNA, 17 nt, Homo sapiens
ccaauuaccacuucuuu

SEQ ID NO: 210111 - RNA, 17 nt, Homo sapiens
cucagugacucaugugc

SEQ ID NO: 210112 - RNA, 21 nt, Homo sapiens
gcaguucugagcacaguacac

SEQ ID NO: 210113 - RNA, 18 nt, Homo sapiens
cuaggggguuugcccuug

SEQ ID NO: 210114 - RNA, 16 nt, Homo sapiens
cucuccucccggcuuc

SEQ ID NO: 210115 - RNA, 21 nt, Homo sapiens
gaguguaguucugagcagagc

SEQ ID NO: 210116 - RNA, 18 nt, Homo sapiens
gggucccggggagggggg

SEQ ID NO: 210117 - RNA, 18 nt, Homo sapiens
uaaaauuugcauccagga

SEQ ID NO: 210118 - RNA, 17 nt, Homo sapiens
uggggcucagcgaguuu

SEQ ID NO: 210119 - RNA, 18 nt, Homo sapiens
gggcucacaucaccccau

SEQ ID NO: 210120 - RNA, 18 nt, Homo sapiens
gcggcgaguccgacucau

SEQ ID NO: 210121 - RNA, 17 nt, Homo sapiens
accccacuccugguacc

SEQ ID NO: 210122 - RNA, 19 nt, Homo sapiens
ucucccuugagggcacuuu

SEQ ID NO: 210123 - RNA, 17 nt, Homo sapiens
uugucugcugaguuucc

SEQ ID NO: 210124 - RNA, 19 nt, Homo sapiens
gcauugugcagggcuauca

SEQ ID NO: 210125 - RNA, 19 nt, Homo sapiens
ugcccuccuuucuucccuc

SEQ ID NO: 210126 - RNA, 16 nt, Homo sapiens
uucagcaggaacagcu

SEQ ID NO: 210127 - RNA, 18 nt, Homo sapiens
ccccugggccggccuugg

SEQ ID NO: 210128 - RNA, 17 nt, Homo sapiens
cagccugacaggaacag

SEQ ID NO: 210129 - RNA, 17 nt, Homo sapiens
gggagucuacagcaggg

SEQ ID NO: 210130 - RNA, 18 nt, Homo sapiens
cagugcaauguuuuccuu

SEQ ID NO: 210131 - RNA, 17 nt, Homo sapiens
augugggcucaggcuca

SEQ ID NO: 210132 - RNA, 16 nt, Homo sapiens
ugccuuccugucugug

SEQ ID NO: 210133 - RNA, 22 nt, Homo sapiens
cugggacaggaggaggaggcag

SEQ ID NO: 210134 - RNA, 18 nt, Homo sapiens
gcuggugacaugagaggc

SEQ ID NO: 210135 - RNA, 18 nt, Homo sapiens
ugggagcuggacuacuuc

SEQ ID NO: 210136 - RNA, 20 nt, Homo sapiens
ucccacuacuucacuuguga

SEQ ID NO: 210137 - RNA, 18 nt, Homo sapiens
ccaguguggcucagcgag

SEQ ID NO: 210138 - RNA, 17 nt, Homo sapiens
uucugagcugaggacag

SEQ ID NO: 210139 - RNA, 17 nt, Homo sapiens
ccggcauguccagggca

SEQ ID NO: 210140 - RNA, 18 nt, Homo sapiens
ccuagacaccuccaguuc

SEQ ID NO: 210141 - RNA, 17 nt, Homo sapiens
uggagagaaaggcagua

SEQ ID NO: 210142 - RNA, 19 nt, Homo sapiens
aauguuuuuuccuguuucc

SEQ ID NO: 210143 - RNA, 18 nt, Homo sapiens
ucccuggaguuucuucuu

SEQ ID NO: 210144 - RNA, 18 nt, Homo sapiens
cuggagucuaggauucca

SEQ ID NO: 210145 - RNA, 16 nt, Homo sapiens
gcagcauucauguccc

SEQ ID NO: 210146 - RNA, 18 nt, Homo sapiens
gaaagagagcugagugug

SEQ ID NO: 210147 - RNA, 19 nt, Homo sapiens
ggccuuguuccugucccca

SEQ ID NO: 210148 - RNA, 20 nt, Homo sapiens
agcccccuggccccaaaccc

SEQ ID NO: 210149 - RNA, 18 nt, Homo sapiens
cucugggaaaugggacag

SEQ ID NO: 210150 - RNA, 18 nt, Homo sapiens
ccgcuuucugagcuggac

SEQ ID NO: 210151 - RNA, 17 nt, Homo sapiens
ggugaggcuagcuggug

SEQ ID NO: 210152 - RNA, 17 nt, Homo sapiens
acauugccagggaguuu

SEQ ID NO: 210153 - RNA, 17 nt, Homo sapiens
cacuguggguacaugcu

SEQ ID NO: 210154 - RNA, 17 nt, Homo sapiens
ucccugagcaaagccac

SEQ ID NO: 210155 - RNA, 18 nt, Homo sapiens
gggauucuguagcuuccu

SEQ ID NO: 210156 - RNA, 21 nt, Homo sapiens
uuagcgguggaccgcccugcg

SEQ ID NO: 210157 - RNA, 21 nt, Homo sapiens
cugugggcucagcgcgugggg

SEQ ID NO: 210158 - RNA, 18 nt, Homo sapiens
cagccccacagccucaga

SEQ ID NO: 210159 - RNA, 20 nt, Homo sapiens
cccugagacccuaaccuuaa

SEQ ID NO: 210160 - RNA, 18 nt, Homo sapiens
uugcacuugucucaguga

SEQ ID NO: 210161 - RNA, 20 nt, Homo sapiens
uguuccucugucucccagac

SEQ ID NO: 210162 - RNA, 19 nt, Homo sapiens
ggcuugcaugggggacugg

SEQ ID NO: 210163 - RNA, 17 nt, Homo sapiens
ccaguuuucccaggauu

SEQ ID NO: 210164 - RNA, 19 nt, Homo sapiens
ccugagacccuaguuccac

SEQ ID NO: 210165 - RNA, 19 nt, Homo sapiens
ccucagaucagagccuugc

SEQ ID NO: 210166 - RNA, 18 nt, Homo sapiens
ggugggcuucccggaggg

SEQ ID NO: 210167 - RNA, 18 nt, Homo sapiens
cacugcaggacucagcag

SEQ ID NO: 210168 - RNA, 17 nt, Homo sapiens
ugagggaggagacugca

SEQ ID NO: 210169 - RNA, 18 nt, Homo sapiens
gaggcugaaggaagaugg

SEQ ID NO: 210170 - RNA, 22 nt, Homo sapiens
gucacugaugucuguagcugag

SEQ ID NO: 210171 - RNA, 22 nt, Homo sapiens
accugucuguggaaaggagcua

SEQ ID NO: 210172 - RNA, 21 nt, Homo sapiens
aaaagcaucaggaaguaccca

SEQ ID NO: 210173 - RNA, 21 nt, Homo sapiens
auaggcaccaaaaagcaacaa

SEQ ID NO: 210174 - RNA, 22 nt, Homo sapiens
aguugccuuuuuguucccaugc

SEQ ID NO: 210175 - RNA, 22 nt, Homo sapiens
agaguuaacucaaaauggacua

SEQ ID NO: 210176 - RNA, 22 nt, Homo sapiens
uguugggauucagcaggaccau

SEQ ID NO: 210177 - RNA, 17 nt, Homo sapiens
gaagauggacguacuuu

SEQ ID NO: 210178 - RNA, 21 nt, Homo sapiens
ucugaauagagucugaagagu

SEQ ID NO: 210179 - RNA, 22 nt, Homo sapiens
caaggagacgggaacauggagc

SEQ ID NO: 210180 - RNA, 20 nt, Homo sapiens
aaaagcugggcugagaggcg

SEQ ID NO: 210181 - RNA, 18 nt, Homo sapiens
aggcuggagugagcggag

SEQ ID NO: 210182 - RNA, 22 nt, Homo sapiens
gcgacucugaaaacuagaaggu

SEQ ID NO: 210183 - RNA, 20 nt, Homo sapiens
aaagacucugcaagaugccu

SEQ ID NO: 210184 - RNA, 21 nt, Homo sapiens
acaggagugggggugggacau

SEQ ID NO: 210185 - RNA, 21 nt, Homo sapiens
cgucccaccccccacuccugu

SEQ ID NO: 210186 - RNA, 18 nt, Homo sapiens
aggagaaguaaaguagaa

SEQ ID NO: 210187 - RNA, 22 nt, Homo sapiens
auggccagagcucacacagagg

SEQ ID NO: 210188 - RNA, 21 nt, Homo sapiens
gcaggacaggcagaaguggau

SEQ ID NO: 210189 - RNA, 22 nt, Homo sapiens
cagggcaggaagaaguggacaa

SEQ ID NO: 210190 - RNA, 22 nt, Homo sapiens
guccacuucugccugcccugcc

SEQ ID NO: 210191 - RNA, 21 nt, Homo sapiens
ugggcucaggguacaaagguu

SEQ ID NO: 210192 - RNA, 21 nt, Homo sapiens
cacaggcuuagaaaagacagu

SEQ ID NO: 210193 - RNA, 22 nt, Homo sapiens
gugacugauaccuuggaggcau

SEQ ID NO: 210194 - RNA, 22 nt, Homo sapiens
ugucguggggcuugcuggcuug

SEQ ID NO: 210195 - RNA, 17 nt, Homo sapiens
acagggaggagauugua

SEQ ID NO: 210196 - RNA, 17 nt, Homo sapiens
gccggacaagagggagg

SEQ ID NO: 210197 - RNA, 17 nt, Homo sapiens
uuggaggcguggguuuu

SEQ ID NO: 210198 - RNA, 18 nt, Homo sapiens
cucgaguuggaagaggcg

SEQ ID NO: 210199 - RNA, 21 nt, Homo sapiens
cacggcaaaagaaacaaucca

SEQ ID NO: 210200 - RNA, 22 nt, Homo sapiens
agauuguuucuuuugccgugca

SEQ ID NO: 210201 - RNA, 22 nt, Homo sapiens
cagggcuggcagugacaugggu

SEQ ID NO: 210202 - RNA, 22 nt, Homo sapiens
auuucccugccauucccuuggc

SEQ ID NO: 210203 - RNA, 17 nt, Homo sapiens
ggugggggcuguuguuu

SEQ ID NO: 210204 - RNA, 20 nt, Homo sapiens
ggcuccuuggucuaggggua

SEQ ID NO: 210205 - RNA, 22 nt, Homo sapiens
cgucccggggcugcgcgaggca

SEQ ID NO: 210206 - RNA, 22 nt, Homo sapiens
uggggauuuggagaagugguga

SEQ ID NO: 210207 - RNA, 17 nt, Homo sapiens
ugguagagcugaggaca

SEQ ID NO: 210208 - RNA, 23 nt, Homo sapiens
uugaauucuuggccuuaagugau

SEQ ID NO: 210209 - RNA, 20 nt, Homo sapiens
gagcuuggucuguagcgguu

SEQ ID NO: 210210 - RNA, 20 nt, Homo sapiens
ggauccgagucacggcacca

SEQ ID NO: 210211 - RNA, 17 nt, Homo sapiens
aggguguguguguuuuu

SEQ ID NO: 210212 - RNA, 17 nt, Homo sapiens
ccugguggcuuccuuuu

SEQ ID NO: 210213 - RNA, 22 nt, Homo sapiens
ucacaagguauugacuggcgua

SEQ ID NO: 210214 - RNA, 19 nt, Homo sapiens
agagguagguguggaagaa

SEQ ID NO: 210215 - RNA, 22 nt, Homo sapiens
ccaggaggcggaggagguggag

SEQ ID NO: 210216 - RNA, 22 nt, Homo sapiens
auagugguugugaauuuaccuu

SEQ ID NO: 210217 - RNA, 23 nt, Homo sapiens
gauugagacuaguagggcuaggc

SEQ ID NO: 210218 - RNA, 23 nt, Homo sapiens
ugacacggaggguggcuugggaa

SEQ ID NO: 210219 - RNA, 17 nt, Homo sapiens
gagacugggguggggcc

SEQ ID NO: 210220 - RNA, 21 nt, Homo sapiens
aagguuuggauagaugcaaua

SEQ ID NO: 210221 - RNA, 22 nt, Homo sapiens
cucaaguagucugaccagggga

SEQ ID NO: 210222 - RNA, 18 nt, Homo sapiens
gggugcgggccggcgggg

SEQ ID NO: 210223 - RNA, 22 nt, Homo sapiens
uggcggcgguaguuaugggcuu

SEQ ID NO: 210224 - RNA, 18 nt, Homo sapiens
agagcagaaggaugagau

SEQ ID NO: 210225 - RNA, 22 nt, Homo sapiens
gcucccucuagggucgcucgga

SEQ ID NO: 210226 - RNA, 21 nt, Homo sapiens
uggcaaacguggaagccgaga

SEQ ID NO: 210227 - RNA, 22 nt, Homo sapiens
ugggaacuuaguagagguuuaa

SEQ ID NO: 210228 - RNA, 18 nt, Homo sapiens
ggugggggguguuguuuu

SEQ ID NO: 210229 - RNA, 22 nt, Homo sapiens
cuagugcucuccguuacaagua

SEQ ID NO: 210230 - RNA, 22 nt, Homo sapiens
uuguggcuggucaugaggcuaa

SEQ ID NO: 210231 - RNA, 21 nt, Homo sapiens
uuagucucaugaucagacaca

SEQ ID NO: 210232 - RNA, 22 nt, Homo sapiens
caagggaccaagcauucauuau

SEQ ID NO: 210233 - RNA, 22 nt, Homo sapiens
caggaaggauuuagggacaggc

SEQ ID NO: 210234 - RNA, 22 nt, Homo sapiens
cuauuaaggacauuugugauuc

SEQ ID NO: 210235 - RNA, 22 nt, Homo sapiens
auuaaggacauuugugauugau

SEQ ID NO: 210236 - RNA, 17 nt, Homo sapiens
gaggcugagcugaggag

SEQ ID NO: 210237 - RNA, 22 nt, Homo sapiens
cgcgcggccgugcucggagcag

SEQ ID NO: 210238 - RNA, 21 nt, Homo sapiens
agccaaguggaaguuacuuua

SEQ ID NO: 210239 - RNA, 17 nt, Homo sapiens
ggagugggcuggugguu

SEQ ID NO: 210240 - RNA, 22 nt, Homo sapiens
uuucuauuucucaguggggcuc

SEQ ID NO: 210241 - RNA, 22 nt, Homo sapiens
aacccagugggcuauggaaaug

SEQ ID NO: 210242 - RNA, 17 nt, Homo sapiens
gggguggucuguuguug

SEQ ID NO: 210243 - RNA, 20 nt, Homo sapiens
aaaaggcgggagaagcccca

SEQ ID NO: 210244 - RNA, 20 nt, Homo sapiens
uaacggccgcgguacccuaa

SEQ ID NO: 210245 - RNA, 17 nt, Homo sapiens
gcugggcgaggcuggca

SEQ ID NO: 210246 - RNA, 19 nt, Homo sapiens
agagcuggcugaagggcag

SEQ ID NO: 210247 - RNA, 18 nt, Homo sapiens
agggggcgggcuccggcg

SEQ ID NO: 210248 - RNA, 21 nt, Homo sapiens
uggggcuagugaugcaggacg

SEQ ID NO: 210249 - RNA, 22 nt, Homo sapiens
ucugguaagagauuugggcaua

SEQ ID NO: 210250 - RNA, 22 nt, Homo sapiens
aauguggacuggugugaccaaa

SEQ ID NO: 210251 - RNA, 17 nt, Homo sapiens
ggggcugggcgcgcgcc

SEQ ID NO: 210252 - RNA, 21 nt, Homo sapiens
agaaggccuuuccaucucugu

SEQ ID NO: 210253 - RNA, 22 nt, Homo sapiens
ccagacuguggcugaccagagg

SEQ ID NO: 210254 - RNA, 21 nt, Homo sapiens
aauguaaacaggcuuuuugcu

SEQ ID NO: 210255 - RNA, 22 nt, Homo sapiens
gaggaaacugaagcugagaggg

SEQ ID NO: 210256 - RNA, 17 nt, Homo sapiens
cuccgggacggcugggc

SEQ ID NO: 210257 - RNA, 22 nt, Homo sapiens
ugggcuggcagggcaagugcug

SEQ ID NO: 210258 - RNA, 17 nt, Homo sapiens
aagacugagaggaggga

SEQ ID NO: 210259 - RNA, 17 nt, Homo sapiens
ugagguaguaguuucuu

SEQ ID NO: 210260 - RNA, 21 nt, Homo sapiens
uaugugaccucggaugaauca

SEQ ID NO: 210261 - RNA, 22 nt, Homo sapiens
gcugaugaugauggugcugaag

SEQ ID NO: 210262 - RNA, 22 nt, Homo sapiens
uuuaagcaggaaauagaauuua

SEQ ID NO: 210263 - RNA, 22 nt, Homo sapiens
ugugacaauagagaugaacaug

SEQ ID NO: 210264 - RNA, 18 nt, Homo sapiens
aggcugggcugggacgga

SEQ ID NO: 210265 - RNA, 20 nt, Homo sapiens
aaauggguggucugaggcaa

SEQ ID NO: 210266 - RNA, 20 nt, Homo sapiens
cuggguugggcugggcuggg

SEQ ID NO: 210267 - RNA, 17 nt, Homo sapiens
gcggggcugggcgcgcg

SEQ ID NO: 210268 - RNA, 22 nt, Homo sapiens
acuaaaggauauagaagguuuu

SEQ ID NO: 210269 - RNA, 22 nt, Homo sapiens
ugagggaguaggauguaugguu

SEQ ID NO: 210270 - RNA, 22 nt, Homo sapiens
gaagaacuguugcauuugcccu

SEQ ID NO: 210271 - RNA, 22 nt, Homo sapiens
cagggccucacuguaucgccca

SEQ ID NO: 210272 - RNA, 22 nt, Homo sapiens
agacugacggcuggaggcccau

SEQ ID NO: 210273 - RNA, 18 nt, Homo sapiens
acaggcaggauuggggaa

SEQ ID NO: 210274 - RNA, 22 nt, Homo sapiens
aggacuggacucccggcagccc

SEQ ID NO: 210275 - RNA, 17 nt, Homo sapiens
gggagaagggucggggc

SEQ ID NO: 210276 - RNA, 25 nt, Homo sapiens
aaauaugaugaaacucacagcugag

SEQ ID NO: 210277 - RNA, 26 nt, Homo sapiens
gcucagggaugauaacugugcugaga

SEQ ID NO: 210278 - RNA, 18 nt, Homo sapiens
cagcagugcgcagggcug

SEQ ID NO: 210279 - RNA, 22 nt, Homo sapiens
uuggacagaaaacacgcaggaa

SEQ ID NO: 210280 - RNA, 20 nt, Homo sapiens
ccugcguguuuucuguccaa

SEQ ID NO: 210281 - RNA, 22 nt, Homo sapiens
uuuggacagaaaacacgcaggu

SEQ ID NO: 210282 - RNA, 20 nt, Homo sapiens
ccugcguguuuucuguccaa

SEQ ID NO: 210283 - RNA, 22 nt, Homo sapiens
gcuaaggaaguccugugcucag

SEQ ID NO: 210284 - RNA, 21 nt, Homo sapiens
ugacucugccuguaggccggu

SEQ ID NO: 210285 - RNA, 21 nt, Homo sapiens
gaccgagagggccucggcugu

SEQ ID NO: 210286 - RNA, 22 nt, Homo sapiens
ugagacaggcuuaugcugcuau

SEQ ID NO: 210287 - RNA, 22 nt, Homo sapiens
auagcagcaugaaccugucuca

SEQ ID NO: 210288 - RNA, 20 nt, Homo sapiens
gagacagguucaugcugcua

SEQ ID NO: 210289 - RNA, 21 nt, Homo sapiens
auagcagcauaagccugucuc

SEQ ID NO: 210290 - RNA, 21 nt, Homo sapiens
ggggggaugugcaugcugguu

SEQ ID NO: 210291 - RNA, 22 nt, Homo sapiens
gcugacagcagggcuggccgcu

SEQ ID NO: 210292 - RNA, 22 nt, Homo sapiens
uggucugcaaagagaugacugu

SEQ ID NO: 210293 - RNA, 22 nt, Homo sapiens
ucauuauauguaugaucuggac

SEQ ID NO: 210294 - RNA, 21 nt, Homo sapiens
auuggacugcugauggcccgu

SEQ ID NO: 210295 - RNA, 22 nt, Homo sapiens
aggccaucagcaguccaaugaa

SEQ ID NO: 210296 - RNA, 18 nt, Homo sapiens
cccagcaggacgggagcg

SEQ ID NO: 210297 - RNA, 17 nt, Homo sapiens
auggagaaggcuucuga

SEQ ID NO: 210298 - RNA, 17 nt, Homo sapiens
ccccggggagcccggcg

SEQ ID NO: 210299 - RNA, 22 nt, Homo sapiens
uggaaggagguugccggacgcu

SEQ ID NO: 210300 - RNA, 17 nt, Homo sapiens
ggauggaggaggggucu

SEQ ID NO: 210301 - RNA, 17 nt, Homo sapiens
guggaccuggcugggac

SEQ ID NO: 210302 - RNA, 21 nt, Homo sapiens
ucgugcauauaucuaccacau

SEQ ID NO: 210303 - RNA, 21 nt, Homo sapiens
ugugguagauauaugcacgau

SEQ ID NO: 210304 - RNA, 22 nt, Homo sapiens
ugagccgagcugagcuuagcug

SEQ ID NO: 210305 - RNA, 22 nt, Homo sapiens
gagcuuggaugagcugggcuga

SEQ ID NO: 210306 - RNA, 22 nt, Homo sapiens
gcugaacugggcugagcugggc

SEQ ID NO: 210307 - RNA, 21 nt, Homo sapiens
uuaguccugccuguagguuua

SEQ ID NO: 210308 - RNA, 22 nt, Homo sapiens
ugccgcccucucgcugcucuag

SEQ ID NO: 210309 - RNA, 23 nt, Homo sapiens
gagggcagcguggguguggcgga

SEQ ID NO: 210310 - RNA, 22 nt, Homo sapiens
aggagcuagccaggcauaugca

SEQ ID NO: 210311 - RNA, 20 nt, Homo sapiens
auaugccuggcuagcuccuc

SEQ ID NO: 210312 - RNA, 19 nt, Homo sapiens
cggcgcgaccggcccgggg

SEQ ID NO: 210313 - RNA, 21 nt, Homo sapiens
ucuugaagucagaacccgcaa

SEQ ID NO: 210314 - RNA, 22 nt, Homo sapiens
aacucguguucaaagccuuuag

SEQ ID NO: 210315 - RNA, 22 nt, Homo sapiens
uacuaacugcagauucaaguga

SEQ ID NO: 210316 - RNA, 23 nt, Homo sapiens
ccuggacaccgcucagccggccg

SEQ ID NO: 210317 - RNA, 21 nt, Homo sapiens
acucggcugcgguggacaagu

SEQ ID NO: 210318 - RNA, 20 nt, Homo sapiens
ucacucucaccuugcuuugc

SEQ ID NO: 210319 - RNA, 22 nt, Homo sapiens
uugcuaaguaggcugagauuga

SEQ ID NO: 210320 - RNA, 22 nt, Homo sapiens
cacccccuguuuccuggcccac

SEQ ID NO: 210321 - RNA, 23 nt, Homo sapiens
ugggccagggagcagcugguggg

SEQ ID NO: 210322 - RNA, 24 nt, Homo sapiens
ugcccaugccauacuuuugccuca

SEQ ID NO: 210323 - RNA, 22 nt, Homo sapiens
auggcaucguccccugguggcu

SEQ ID NO: 210324 - RNA, 22 nt, Homo sapiens
gacacaugaccauaaaugcuaa

SEQ ID NO: 210325 - RNA, 23 nt, Homo sapiens
uggagagagaaaagagacagaag

SEQ ID NO: 210326 - RNA, 22 nt, Homo sapiens
agacaguaguucuugccugguu

SEQ ID NO: 210327 - RNA, 19 nt, Homo sapiens
accaggcaagaaauauugu

SEQ ID NO: 210328 - RNA, 21 nt, Homo sapiens
auugucccucucccuucccag

SEQ ID NO: 210329 - RNA, 22 nt, Homo sapiens
acugggaagaggagcugaggga

SEQ ID NO: 210330 - RNA, 23 nt, Homo sapiens
gaagauggugcugugcugaggaa

SEQ ID NO: 210331 - RNA, 20 nt, Homo sapiens
ugugggacugcaaaugggag

SEQ ID NO: 210332 - RNA, 21 nt, Homo sapiens
ucugaggccugccucucccca

SEQ ID NO: 210333 - RNA, 24 nt, Homo sapiens
ugggcgaggggugggcucucagag

SEQ ID NO: 210334 - RNA, 21 nt, Homo sapiens
agguagaaugaggccugacau

SEQ ID NO: 210335 - RNA, 19 nt, Homo sapiens
ucaggccucuuucuaccuu

SEQ ID NO: 210336 - RNA, 20 nt, Homo sapiens
cggggugggugaggucgggc

SEQ ID NO: 210337 - RNA, 22 nt, Homo sapiens
guucuguuaacccauccccuca

SEQ ID NO: 210338 - RNA, 22 nt, Homo sapiens
aggggacugguuaauagaacua

SEQ ID NO: 210339 - RNA, 23 nt, Homo sapiens
uggaguuaaggguugcuuggaga

SEQ ID NO: 210340 - RNA, 22 nt, Homo sapiens
ucucugagcaaggcuuaacacc

SEQ ID NO: 210341 - RNA, 22 nt, Homo sapiens
ugugggaucuggaggcaucugg

SEQ ID NO: 210342 - RNA, 21 nt, Homo sapiens
acccucgucagguccccgggg

SEQ ID NO: 210343 - RNA, 22 nt, Homo sapiens
caccggggauggcagagggucg

SEQ ID NO: 210344 - RNA, 23 nt, Homo sapiens
ugggcugagggcaggaggccugu

SEQ ID NO: 210345 - RNA, 23 nt, Homo sapiens
aauguggaaguggucugaggcau

SEQ ID NO: 210346 - RNA, 23 nt, Homo sapiens
gugaguguggauccuggaggaau

SEQ ID NO: 210347 - RNA, 22 nt, Homo sapiens
uuucuucuuagacauggcaacg

SEQ ID NO: 210348 - RNA, 22 nt, Homo sapiens
cugccaugucuaagaagaaaac

SEQ ID NO: 210349 - RNA, 22 nt, Homo sapiens
uuucuucuuagacauggcagcu

SEQ ID NO: 210350 - RNA, 19 nt, Homo sapiens
uugccaugucuaagaagaa

SEQ ID NO: 210351 - RNA, 23 nt, Homo sapiens
ugcagcucugguggaaaauggag

SEQ ID NO: 210352 - RNA, 22 nt, Homo sapiens
caggauccacagagcuagucca

SEQ ID NO: 210353 - RNA, 22 nt, Homo sapiens
aacuagcucuguggauccugac

SEQ ID NO: 210354 - RNA, 22 nt, Homo sapiens
aaagauagacaauuggcuaaau

SEQ ID NO: 210355 - RNA, 22 nt, Homo sapiens
uuagccaauuguccaucuuuag

SEQ ID NO: 210356 - RNA, 22 nt, Homo sapiens
aaagauggacaauuggcuaaau

SEQ ID NO: 210357 - RNA, 24 nt, Homo sapiens
agcugagcuccauggacgugcagu

SEQ ID NO: 210358 - RNA, 22 nt, Homo sapiens
cuuccggucugugagccccguc

SEQ ID NO: 210359 - RNA, 22 nt, Homo sapiens
uggggugcccacuccgcaaguu

SEQ ID NO: 210360 - RNA, 26 nt, Homo sapiens
cucggccgcggcgcguagcccccgcc

SEQ ID NO: 210361 - RNA, 23 nt, Homo sapiens
cugggggacgcgugagcgcgagc

SEQ ID NO: 210362 - RNA, 21 nt, Homo sapiens
cauacaaucugacauguauuu

SEQ ID NO: 210363 - RNA, 21 nt, Homo sapiens
auacaugucagauuguaugcc

SEQ ID NO: 210364 - RNA, 23 nt, Homo sapiens
uugcaugucagauuguaauuccc

SEQ ID NO: 210365 - RNA, 21 nt, Homo sapiens
ucccuccuucuguccccacag

SEQ ID NO: 210366 - RNA, 22 nt, Homo sapiens
acuggggagcagaaggagaacc

SEQ ID NO: 210367 - RNA, 23 nt, Homo sapiens
gaaaauccuuuuuguuuuuccag

SEQ ID NO: 210368 - RNA, 23 nt, Homo sapiens
agggaaaaaaaaaaggauuuguc

SEQ ID NO: 210369 - RNA, 22 nt, Homo sapiens
uguguccgggaaguggaggagg

SEQ ID NO: 210370 - RNA, 22 nt, Homo sapiens
ugaaguuacaucauggucgcuu

SEQ ID NO: 210371 - RNA, 22 nt, Homo sapiens
aagcgaccaugauguaacuuca

SEQ ID NO: 210372 - RNA, 21 nt, Homo sapiens
uuagugcauagucuuuggucu

SEQ ID NO: 210373 - RNA, 22 nt, Homo sapiens
accgaagacugugcgcuaaucu

SEQ ID NO: 210374 - RNA, 21 nt, Homo sapiens
uuacacagcuggacagaggca

SEQ ID NO: 210375 - RNA, 22 nt, Homo sapiens
uccaggcaggagccggacugga

SEQ ID NO: 210376 - RNA, 21 nt, Homo sapiens
cugggcucgggacgcgcggcu

SEQ ID NO: 210377 - RNA, 22 nt, Homo sapiens
ggggcugugauugaccagcagg

SEQ ID NO: 210378 - RNA, 22 nt, Homo sapiens
cacuguuucaccacuggcucuu

SEQ ID NO: 210379 - RNA, 21 nt, Homo sapiens
gagccaguggugagacaguga

SEQ ID NO: 210380 - RNA, 22 nt, Homo sapiens
ucugugagaccaaagaacuacu

SEQ ID NO: 210381 - RNA, 22 nt, Homo sapiens
uuguucuuuggucuuucagcca

SEQ ID NO: 210382 - RNA, 22 nt, Homo sapiens
aagguauuguucagacuuauga

SEQ ID NO: 210383 - RNA, 22 nt, Homo sapiens
ucugugauagagauucuuugcu

SEQ ID NO: 210384 - RNA, 21 nt, Homo sapiens
ucugaauuguaagaguuguua

SEQ ID NO: 210385 - RNA, 23 nt, Homo sapiens
agaacucuugcagucuuagaugu

SEQ ID NO: 210386 - RNA, 22 nt, Homo sapiens
aacgggaaugcaggcuguaucu

SEQ ID NO: 210387 - RNA, 23 nt, Homo sapiens
ucugaguuccuggagccuggucu

SEQ ID NO: 210388 - RNA, 23 nt, Homo sapiens
uggagauccagugcucgcccgau

SEQ ID NO: 210389 - RNA, 22 nt, Homo sapiens
uguugcaagucgguggagacgu

SEQ ID NO: 210390 - RNA, 22 nt, Homo sapiens
cucucuacugacuugcaacaua

SEQ ID NO: 210391 - RNA, 22 nt, Homo sapiens
ucucccuuccugcccuggcuag

SEQ ID NO: 210392 - RNA, 26 nt, Homo sapiens
cccagggcuuggaguggggcaagguu

SEQ ID NO: 210393 - RNA, 23 nt, Homo sapiens
uaucugcugggcuuucugguguu

SEQ ID NO: 210394 - RNA, 21 nt, Homo sapiens
uggcuguuggagggggcaggc

SEQ ID NO: 210395 - RNA, 22 nt, Homo sapiens
cagcccuccucccgcacccaaa

SEQ ID NO: 210396 - RNA, 22 nt, Homo sapiens
uaggggcagcagaggaccuggg

SEQ ID NO: 210397 - RNA, 22 nt, Homo sapiens
uugaggagacauggugggggcc

SEQ ID NO: 210398 - RNA, 21 nt, Homo sapiens
gcagcccagcugaggccucug

SEQ ID NO: 210399 - RNA, 22 nt, Homo sapiens
gagcaggcgaggcugggcugaa

SEQ ID NO: 210400 - RNA, 23 nt, Homo sapiens
ccagccacggacugagagugcau

SEQ ID NO: 210401 - RNA, 23 nt, Homo sapiens
guccuccaggccaugagcugcgg

SEQ ID NO: 210402 - RNA, 22 nt, Homo sapiens
ucaggcaguguggguaucagau

SEQ ID NO: 210403 - RNA, 23 nt, Homo sapiens
ugagaguggaauucacaguauuu

SEQ ID NO: 210404 - RNA, 23 nt, Homo sapiens
auacugugaauuucacugucaca

SEQ ID NO: 210405 - RNA, 21 nt, Homo sapiens
caaauggacaggauaacaccu

SEQ ID NO: 210406 - RNA, 22 nt, Homo sapiens
agguguuauccuauccauuugc

SEQ ID NO: 210407 - RNA, 22 nt, Homo sapiens
ugaucucaccgcugccuccuuc

SEQ ID NO: 210408 - RNA, 22 nt, Homo sapiens
caggaggcagugggcgagcagg

SEQ ID NO: 210409 - RNA, 22 nt, Homo sapiens
ugcaagacggauacugucaucu

SEQ ID NO: 210410 - RNA, 24 nt, Homo sapiens
ugucagugacuccugccccuuggu

SEQ ID NO: 210411 - RNA, 22 nt, Homo sapiens
agggggcgcagucacugacgug

SEQ ID NO: 210412 - RNA, 23 nt, Homo sapiens
ucaaaauguagaggaagacccca

SEQ ID NO: 210413 - RNA, 22 nt, Homo sapiens
aauuuacucugcaaucuucucc

SEQ ID NO: 210414 - RNA, 22 nt, Homo sapiens
agaagauugcagaguaaguucc

SEQ ID NO: 210415 - RNA, 26 nt, Homo sapiens
cacaggacugacuccucaccccagug

SEQ ID NO: 210416 - RNA, 22 nt, Homo sapiens
ucuggggaugaggacagugugu

SEQ ID NO: 210417 - RNA, 20 nt, Homo sapiens
augggugauggguguggugu

SEQ ID NO: 210418 - RNA, 22 nt, Homo sapiens
uuggccaccacaccuaccccuu

SEQ ID NO: 210419 - RNA, 22 nt, Homo sapiens
uguaguuguauuguauugccac

SEQ ID NO: 210420 - RNA, 23 nt, Homo sapiens
uagcaauacaguacaaauauagu

SEQ ID NO: 210421 - RNA, 22 nt, Homo sapiens
ucagucacauaucuagugucua

SEQ ID NO: 210422 - RNA, 22 nt, Homo sapiens
gacacuaggcaugugagugauu

SEQ ID NO: 210423 - RNA, 22 nt, Homo sapiens
ucaaucacuugguaauugcugu

SEQ ID NO: 210424 - RNA, 25 nt, Homo sapiens
agcggggaggaagugggcgcugcuu

SEQ ID NO: 210425 - RNA, 22 nt, Homo sapiens
agcccgccccagccgagguucu

SEQ ID NO: 210426 - RNA, 23 nt, Homo sapiens
gccccggcgcgggcggguucugg

SEQ ID NO: 210427 - RNA, 22 nt, Homo sapiens
agcaaggcggcaucucucugau

SEQ ID NO: 210428 - RNA, 21 nt, Homo sapiens
agagaugccgccuugcuccuu

SEQ ID NO: 210429 - RNA, 23 nt, Homo sapiens
uugaagaggaggugcucuguagc

SEQ ID NO: 210430 - RNA, 22 nt, Homo sapiens
acaacagugacuugcucuccaa

SEQ ID NO: 210431 - RNA, 18 nt, Homo sapiens
gggugagggcaggugguu

SEQ ID NO: 210432 - RNA, 18 nt, Homo sapiens
cgugucuucuggcuugau

SEQ ID NO: 210433 - RNA, 23 nt, Homo sapiens
ugcaucaggccagaagacaugag

SEQ ID NO: 210434 - RNA, 21 nt, Homo sapiens
aaugagagaccuguacuguau

SEQ ID NO: 210435 - RNA, 22 nt, Homo sapiens
uccaguacaggucucucauuuc

SEQ ID NO: 210436 - RNA, 22 nt, Homo sapiens
ugggauccagacagugggagaa

SEQ ID NO: 210437 - RNA, 22 nt, Homo sapiens
uucucccacuaccaggcuccca

SEQ ID NO: 210438 - RNA, 22 nt, Homo sapiens
ccaaccuagguggucagaguug

SEQ ID NO: 210439 - RNA, 22 nt, Homo sapiens
aacucugaccccuuagguugau

SEQ ID NO: 210440 - RNA, 23 nt, Homo sapiens
gugccaccuuaacugcagccaau

SEQ ID NO: 210441 - RNA, 22 nt, Homo sapiens
aaguuggcugcaguuaaggugg

SEQ ID NO: 210442 - RNA, 22 nt, Homo sapiens
aagggggaaggaaacauggaga

SEQ ID NO: 210443 - RNA, 22 nt, Homo sapiens
uccauguuuccuucccccuucu

SEQ ID NO: 210444 - RNA, 21 nt, Homo sapiens
acacauggguggcuguggccu

SEQ ID NO: 210445 - RNA, 22 nt, Homo sapiens
uaggccacagccacccaugugu

SEQ ID NO: 210446 - RNA, 21 nt, Homo sapiens
agcuguaccugaaaccaagca

SEQ ID NO: 210447 - RNA, 22 nt, Homo sapiens
ucacaaaucuauaauaugcagg

SEQ ID NO: 210448 - RNA, 21 nt, Homo sapiens
ugcuuaaguuguaccaaguau

SEQ ID NO: 210449 - RNA, 22 nt, Homo sapiens
ccuggcauauuugguauaacuu

SEQ ID NO: 210450 - RNA, 22 nt, Homo sapiens
ugagggcuccaggugacggugg

SEQ ID NO: 210451 - RNA, 22 nt, Homo sapiens
accugccagcaccucccugcag

SEQ ID NO: 210452 - RNA, 23 nt, Homo sapiens
ggcaggagggcugugccagguug

SEQ ID NO: 210453 - RNA, 22 nt, Homo sapiens
cccucucuggcuccuccccaaa

SEQ ID NO: 210454 - RNA, 24 nt, Homo sapiens
ugggggagccaugagauaagagca

SEQ ID NO: 210455 - RNA, 21 nt, Homo sapiens
guaccuucugguucagcuagu

SEQ ID NO: 210456 - RNA, 23 nt, Homo sapiens
aacugaaccaggagugagcuucg

SEQ ID NO: 210457 - RNA, 22 nt, Homo sapiens
uggggaaggcgucagugucggg

SEQ ID NO: 210458 - RNA, 21 nt, Homo sapiens
agacccugcagccuucccacc

SEQ ID NO: 210459 - RNA, 22 nt, Homo sapiens
acccagguucccucuggccgca

SEQ ID NO: 210460 - RNA, 23 nt, Homo sapiens
agggccagaggagccuggagugg

SEQ ID NO: 210461 - RNA, 22 nt, Homo sapiens
auagugggaagcuggcagauuc

SEQ ID NO: 210462 - RNA, 21 nt, Homo sapiens
aucugccagcuuccacagugg

SEQ ID NO: 210463 - RNA, 25 nt, Homo sapiens
caugcugaccucccuccugccccag

SEQ ID NO: 210464 - RNA, 23 nt, Homo sapiens
ugggaggggagaggcagcaagca

SEQ ID NO: 210465 - RNA, 22 nt, Homo sapiens
ucauuuaucuguugggaagcua

SEQ ID NO: 210466 - RNA, 23 nt, Homo sapiens
cuggcggagcccauuccaugcca

SEQ ID NO: 210467 - RNA, 22 nt, Homo sapiens
cacacaaguggcccccaacacu

SEQ ID NO: 210468 - RNA, 22 nt, Homo sapiens
ugcugggggccacaugagugug

SEQ ID NO: 210469 - RNA, 21 nt, Homo sapiens
gcccugaccuguccuguucug

SEQ ID NO: 210470 - RNA, 23 nt, Homo sapiens
uguagagcagggagcaggaagcu

SEQ ID NO: 210471 - RNA, 22 nt, Homo sapiens
ccaccaggucuagcauugggau

SEQ ID NO: 210472 - RNA, 22 nt, Homo sapiens
aaucccaaugcuagacccggug

SEQ ID NO: 210473 - RNA, 22 nt, Homo sapiens
gcugcgggcugcggucagggcg

SEQ ID NO: 210474 - RNA, 21 nt, Homo sapiens
aaaggugcucaaauuagacau

SEQ ID NO: 210475 - RNA, 22 nt, Homo sapiens
ccuaauuugaacaccuucggua

SEQ ID NO: 210476 - RNA, 19 nt, Homo sapiens
aggcagguuaucugggcug

SEQ ID NO: 210477 - RNA, 20 nt, Homo sapiens
augcgaggaugcugacagug

SEQ ID NO: 210478 - RNA, 22 nt, Homo sapiens
ugaaacuggagcgccuggagga

SEQ ID NO: 210479 - RNA, 22 nt, Homo sapiens
accagcgcguuuucaguuucau

SEQ ID NO: 210480 - RNA, 25 nt, Homo sapiens
aagggaggaggagcggaggggcccu

SEQ ID NO: 210481 - RNA, 22 nt, Homo sapiens
gcccgagaggauccgucccugc

SEQ ID NO: 210482 - RNA, 22 nt, Homo sapiens
aggacugauccucucgggcagg

SEQ ID NO: 210483 - RNA, 23 nt, Homo sapiens
cgggcuguccggaggggucggcu

SEQ ID NO: 210484 - RNA, 23 nt, Homo sapiens
ucuguauucuccuuugccugcag

SEQ ID NO: 210485 - RNA, 23 nt, Homo sapiens
ucaggcaaagggauauuuacaga

SEQ ID NO: 210486 - RNA, 21 nt, Homo sapiens
uuucugucuuuucugguccag

SEQ ID NO: 210487 - RNA, 23 nt, Homo sapiens
uggccggaugggacaggaggcau

SEQ ID NO: 210488 - RNA, 23 nt, Homo sapiens
ucuaaagacuagacuucgcuaug

SEQ ID NO: 210489 - RNA, 23 nt, Homo sapiens
uggcccggcgacgucucacgguc

SEQ ID NO: 210490 - RNA, 23 nt, Homo sapiens
ugaguggggcucccgggacggcg

SEQ ID NO: 210491 - RNA, 21 nt, Homo sapiens
agcggugcuccugcgggccga

SEQ ID NO: 210492 - RNA, 23 nt, Homo sapiens
ccggucccaggagaaccugcaga

SEQ ID NO: 210493 - RNA, 22 nt, Homo sapiens
aaggcccgggcuuuccucccag

SEQ ID NO: 210494 - RNA, 22 nt, Homo sapiens
agggaaggaggcuuggucuuag

SEQ ID NO: 210495 - RNA, 21 nt, Homo sapiens
gagguuuggggaggauuugcu

SEQ ID NO: 210496 - RNA, 20 nt, Homo sapiens
cgccccuccugcccccacag

SEQ ID NO: 210497 - RNA, 22 nt, Homo sapiens
ugcggggacaggccagggcauc

SEQ ID NO: 210498 - RNA, 22 nt, Homo sapiens
ccugacccacccccucccgcag

SEQ ID NO: 210499 - RNA, 22 nt, Homo sapiens
cucgggcggaggugguugagug

SEQ ID NO: 210500 - RNA, 24 nt, Homo sapiens
agaggacccguagcugcuagaagg

SEQ ID NO: 210501 - RNA, 22 nt, Homo sapiens
uuguggaucucaaggaugugcu

SEQ ID NO: 210502 - RNA, 22 nt, Homo sapiens
uucucuuucuuuagccuugugu

SEQ ID NO: 210503 - RNA, 22 nt, Homo sapiens
caaggccaaaggaagagaacag

SEQ ID NO: 210504 - RNA, 23 nt, Homo sapiens
augcggaccuggguuagcggagu

SEQ ID NO: 210505 - RNA, 22 nt, Homo sapiens
agccaggcucugaagggaaagu

SEQ ID NO: 210506 - RNA, 22 nt, Homo sapiens
uuucccuucagagccuggcuuu

SEQ ID NO: 210507 - RNA, 22 nt, Homo sapiens
ccagagaugguugccuuccuau

SEQ ID NO: 210508 - RNA, 23 nt, Homo sapiens
cagggaggcgcucacucucugcu

SEQ ID NO: 210509 - RNA, 22 nt, Homo sapiens
caugacgucacagaggcuucgc

SEQ ID NO: 210510 - RNA, 23 nt, Homo sapiens
aggccucugugacgucacggugu

SEQ ID NO: 210511 - RNA, 23 nt, Homo sapiens
ugccccaccugcugaccacccuc

SEQ ID NO: 210512 - RNA, 23 nt, Homo sapiens
gugagugggagccgguggggcug

SEQ ID NO: 210513 - RNA, 21 nt, Homo sapiens
uaggacuagauguuggaauua

SEQ ID NO: 210514 - RNA, 22 nt, Homo sapiens
aaauucauguucaaucuaaacc

SEQ ID NO: 210515 - RNA, 22 nt, Homo sapiens
uuuagauugaacaugaaguuag

SEQ ID NO: 210516 - RNA, 21 nt, Homo sapiens
gagggcaugcgcacuuugucc

SEQ ID NO: 210517 - RNA, 21 nt, Homo sapiens
acaaggugugcaugccugacc

SEQ ID NO: 210518 - RNA, 22 nt, Homo sapiens
cuucugaucaagauuuguggug

SEQ ID NO: 210519 - RNA, 21 nt, Homo sapiens
ccaaaucuugaucagaagccu

SEQ ID NO: 210520 - RNA, 24 nt, Homo sapiens
aggcaggggcuggugcugggcggg

SEQ ID NO: 210521 - RNA, 21 nt, Homo sapiens
cgccugcccagcccuccugcu

SEQ ID NO: 210522 - RNA, 22 nt, Homo sapiens
uuaacuccuuucacacccaugg

SEQ ID NO: 210523 - RNA, 21 nt, Homo sapiens
uggauguggaaggaguuaucu

SEQ ID NO: 210524 - RNA, 22 nt, Homo sapiens
ugagugauugauagcuauguuc

SEQ ID NO: 210525 - RNA, 21 nt, Homo sapiens
auagcaauugcucuuuuggaa

SEQ ID NO: 210526 - RNA, 21 nt, Homo sapiens
ucugaaagagcaguugguguu

SEQ ID NO: 210527 - RNA, 23 nt, Homo sapiens
cgcgggcgcuccuggccgccgcc

SEQ ID NO: 210528 - RNA, 20 nt, Homo sapiens
ccaggagauccagagagaau

SEQ ID NO: 210529 - RNA, 22 nt, Homo sapiens
auucucucuggaucccauggau

SEQ ID NO: 210530 - RNA, 22 nt, Homo sapiens
ucugccauccucccuccccuac

SEQ ID NO: 210531 - RNA, 24 nt, Homo sapiens
ggugggauggagagaagguaugag

SEQ ID NO: 210532 - RNA, 18 nt, Homo sapiens
ugagaugacacuguagcu

SEQ ID NO: 210533 - RNA, 21 nt, Homo sapiens
agcagacuugaccuacaauua

SEQ ID NO: 210534 - RNA, 22 nt, Homo sapiens
ccugcaacuuugccugaucaga

SEQ ID NO: 210535 - RNA, 22 nt, Homo sapiens
ugaucaggcaaaauugcagacu

SEQ ID NO: 210536 - RNA, 22 nt, Homo sapiens
cagaacaggagcauagaaaggc

SEQ ID NO: 210537 - RNA, 21 nt, Homo sapiens
auugccuaacaugugccagaa

SEQ ID NO: 210538 - RNA, 22 nt, Homo sapiens
ucugguauguaguagguaauaa

SEQ ID NO: 210539 - RNA, 22 nt, Homo sapiens
uuaauuuuuuguuucggucacu

SEQ ID NO: 210540 - RNA, 23 nt, Homo sapiens
cuugccauccugguccacugcau

SEQ ID NO: 210541 - RNA, 22 nt, Homo sapiens
guggaccaggauggcaagggcu

SEQ ID NO: 210542 - RNA, 22 nt, Homo sapiens
auaccucaucuagaaugcugua

SEQ ID NO: 210543 - RNA, 22 nt, Homo sapiens
uucuagaugagagauauauaua

SEQ ID NO: 210544 - RNA, 22 nt, Homo sapiens
ucuucuuccuuugcagaguuga

SEQ ID NO: 210545 - RNA, 22 nt, Homo sapiens
aauucuguaaaggaagaagagg

SEQ ID NO: 210546 - RNA, 22 nt, Homo sapiens
uaggagggaauaguaaaagcag

SEQ ID NO: 210547 - RNA, 22 nt, Homo sapiens
acccuugagccugaucccuagc

SEQ ID NO: 210548 - RNA, 22 nt, Homo sapiens
aauguuggaauccucgcuagag

SEQ ID NO: 210549 - RNA, 21 nt, Homo sapiens
uagcggggauuccaauauugg

SEQ ID NO: 210550 - RNA, 22 nt, Homo sapiens
ugauugucuucauaucuagaac

SEQ ID NO: 210551 - RNA, 22 nt, Homo sapiens
uucuggauaugaagacaaucaa

SEQ ID NO: 210552 - RNA, 23 nt, Homo sapiens
ccccgguguuggggcgcgucugc

SEQ ID NO: 210553 - RNA, 21 nt, Homo sapiens
ggcgcgcccagcucccgggcu

SEQ ID NO: 210554 - RNA, 20 nt, Homo sapiens
ugaggagaugcugggacuga

SEQ ID NO: 210555 - RNA, 21 nt, Homo sapiens
agagucggcgacgccgccagc

SEQ ID NO: 210556 - RNA, 22 nt, Homo sapiens
ugaagccagcucuggucugggc

SEQ ID NO: 210557 - RNA, 22 nt, Homo sapiens
ugagaccaggacuggaugcacc

SEQ ID NO: 210558 - RNA, 24 nt, Homo sapiens
gaugcgccgcccacugccccgcgc

SEQ ID NO: 210559 - RNA, 22 nt, Homo sapiens
gcggggguggcggcggcauccc

SEQ ID NO: 210560 - RNA, 22 nt, Homo sapiens
uuacggaccagcuaagggaggc

SEQ ID NO: 210561 - RNA, 21 nt, Homo sapiens
cacacauagcagguguauaua

SEQ ID NO: 210562 - RNA, 22 nt, Homo sapiens
guauacaccugauauguguaug

SEQ ID NO: 210563 - RNA, 22 nt, Homo sapiens
ugaaugguaaagcgaugucaca

SEQ ID NO: 210564 - RNA, 20 nt, Homo sapiens
aucgcuuuaccauucauguu

SEQ ID NO: 210565 - RNA, 18 nt, Homo sapiens
uggauaugaugacugaaa

SEQ ID NO: 210566 - RNA, 18 nt, Homo sapiens
cggugagcgcucgcuggc

SEQ ID NO: 210567 - RNA, 23 nt, Homo sapiens
ucugcacugugaguuggcuggcu

SEQ ID NO: 210568 - RNA, 24 nt, Homo sapiens
acauccugcuccacagggcagagg

SEQ ID NO: 210569 - RNA, 22 nt, Homo sapiens
ucuggcuaucucacgagacugu

SEQ ID NO: 210570 - RNA, 22 nt, Homo sapiens
auauuauuagccacuucuggau

SEQ ID NO: 210571 - RNA, 21 nt, Homo sapiens
agaaguggcuaauaauauuga

SEQ ID NO: 210572 - RNA, 22 nt, Homo sapiens
uaaaguggcagaguauagacac

SEQ ID NO: 210573 - RNA, 22 nt, Homo sapiens
ugucuauacucugucacuuuac

SEQ ID NO: 210574 - RNA, 21 nt, Homo sapiens
ucucaguaaguggcacucugu

SEQ ID NO: 210575 - RNA, 21 nt, Homo sapiens
gacagagugccacuuacugaa

SEQ ID NO: 210576 - RNA, 22 nt, Homo sapiens
aacucacgaaguauaccgaagu

SEQ ID NO: 210577 - RNA, 22 nt, Homo sapiens
uucgguauacuuugugaauugg

SEQ ID NO: 210578 - RNA, 22 nt, Homo sapiens
acuggcaugcugcauuuauaua

SEQ ID NO: 210579 - RNA, 22 nt, Homo sapiens
aucuaaaugcagcaugccaguc

SEQ ID NO: 210580 - RNA, 19 nt, Homo sapiens
cauccguccgucuguccac

SEQ ID NO: 210581 - RNA, 21 nt, Homo sapiens
aguggaccgaggaaggaagga

SEQ ID NO: 210582 - RNA, 22 nt, Homo sapiens
uacacaagaaaaccaaggcuca

SEQ ID NO: 210583 - RNA, 23 nt, Homo sapiens
uacauggauggaaaccuucaagc

SEQ ID NO: 210584 - RNA, 22 nt, Homo sapiens
uauggagguucuagaccauguu

SEQ ID NO: 210585 - RNA, 21 nt, Homo sapiens
uaacauaauaguguggauuga

SEQ ID NO: 210586 - RNA, 21 nt, Homo sapiens
ugcuuaaccuugcccucgaaa

SEQ ID NO: 210587 - RNA, 21 nt, Homo sapiens
uuggacgguaagguuaagcaa

SEQ ID NO: 210588 - RNA, 20 nt, Homo sapiens
ucacuaccugacaauacagu

SEQ ID NO: 210589 - RNA, 21 nt, Homo sapiens
ugcuguauugucagguaguga

SEQ ID NO: 210590 - RNA, 22 nt, Homo sapiens
aacaucacagcaagucugugcu

SEQ ID NO: 210591 - RNA, 21 nt, Homo sapiens
uuaagacuugcagugauguuu

SEQ ID NO: 210592 - RNA, 22 nt, Homo sapiens
aacaucacugcaagucuuaaca

SEQ ID NO: 210593 - RNA, 21 nt, Homo sapiens
acagacuugcugugauguuca

SEQ ID NO: 210594 - RNA, 22 nt, Homo sapiens
ucaggacacuucugaacuugga

SEQ ID NO: 210595 - RNA, 22 nt, Homo sapiens
caguucagaaguguuccugagu

SEQ ID NO: 210596 - RNA, 22 nt, Homo sapiens
uucugccucuguccagguccuu

SEQ ID NO: 210597 - RNA, 24 nt, Homo sapiens
agggcuggacucagcggcggagcu

SEQ ID NO: 210598 - RNA, 21 nt, Homo sapiens
ugacugccucacugaccacuu

SEQ ID NO: 210599 - RNA, 24 nt, Homo sapiens
aauuugguuucugaggcacuuagu

SEQ ID NO: 210600 - RNA, 21 nt, Homo sapiens
uacuuuucuagguuguugggg

SEQ ID NO: 210601 - RNA, 23 nt, Homo sapiens
ucacaacaaccuugcaggguaga

SEQ ID NO: 210602 - RNA, 22 nt, Homo sapiens
cuuggauuuuccugggccucag

SEQ ID NO: 210603 - RNA, 22 nt, Homo sapiens
ugaggacagggcaaauucacga

SEQ ID NO: 210604 - RNA, 21 nt, Homo sapiens
uuucccuuuccauccuggcag

SEQ ID NO: 210605 - RNA, 21 nt, Homo sapiens
uugccagggcaggagguggaa

SEQ ID NO: 210606 - RNA, 22 nt, Homo sapiens
aucauaugaaccaaacucuaau

SEQ ID NO: 210607 - RNA, 22 nt, Homo sapiens
uagagucuggcugauaugguuu

SEQ ID NO: 210608 - RNA, 21 nt, Homo sapiens
ccugugcucccagggccucgc

SEQ ID NO: 210609 - RNA, 22 nt, Homo sapiens
ugaggcccuuggggcacagugg

SEQ ID NO: 210610 - RNA, 22 nt, Homo sapiens
uccuaaaucugaaaguccaaaa

SEQ ID NO: 210611 - RNA, 24 nt, Homo sapiens
uuggacuuuuucagauuuggggau

SEQ ID NO: 210612 - RNA, 22 nt, Homo sapiens
uuuugugucucccauuccccag

SEQ ID NO: 210613 - RNA, 22 nt, Homo sapiens
agggggauggcagagcaaaauu

SEQ ID NO: 210614 - RNA, 22 nt, Homo sapiens
gugcauggcuguauauauaaca

SEQ ID NO: 210615 - RNA, 21 nt, Homo sapiens
uauauauacagccaugcacuc

SEQ ID NO: 210616 - RNA, 21 nt, Homo sapiens
uugcagcugcgguuguaaggu

SEQ ID NO: 210617 - RNA, 23 nt, Homo sapiens
ggguuuguagcuuugcuggcaug

SEQ ID NO: 210618 - RNA, 23 nt, Homo sapiens
cagggcucagggauuggauggag

SEQ ID NO: 210619 - RNA, 23 nt, Homo sapiens
augcuacucggaaaucccacuga

SEQ ID NO: 210620 - RNA, 21 nt, Homo sapiens
gugggauuucugaguagcauc

SEQ ID NO: 210621 - RNA, 23 nt, Homo sapiens
ccggggcagauugguguagggug

SEQ ID NO: 210622 - RNA, 23 nt, Homo sapiens
acggagacgacaagacugugcug

SEQ ID NO: 210623 - RNA, 22 nt, Homo sapiens
aauccacgcugagcuuggcauc

SEQ ID NO: 210624 - RNA, 23 nt, Homo sapiens
aggaaaugaggcuggcuaggagc

SEQ ID NO: 210625 - RNA, 22 nt, Homo sapiens
aaucagugaaugccuugaaccu

SEQ ID NO: 210626 - RNA, 21 nt, Homo sapiens
uuacaggcgugaaccaccgcg

SEQ ID NO: 210627 - RNA, 21 nt, Homo sapiens
guuucaccauguuggucaggc

SEQ ID NO: 210628 - RNA, 22 nt, Homo sapiens
uucagaucccagcggugccucu

SEQ ID NO: 210629 - RNA, 21 nt, Homo sapiens
agagauugguagaaaucaggu

SEQ ID NO: 210630 - RNA, 21 nt, Homo sapiens
acugaauccucuuuuccucag

SEQ ID NO: 210631 - RNA, 22 nt, Homo sapiens
ugggaugagggauugaagugga

SEQ ID NO: 210632 - RNA, 23 nt, Homo sapiens
aaucggacccauuuaaaccggag

SEQ ID NO: 210633 - RNA, 24 nt, Homo sapiens
ucugggcacaggcggauggacagg

SEQ ID NO: 210634 - RNA, 21 nt, Homo sapiens
ccagugacugagcuggagcca

SEQ ID NO: 210635 - RNA, 22 nt, Homo sapiens
aggauaggaagaaugaagugcu

SEQ ID NO: 210636 - RNA, 22 nt, Homo sapiens
aggagaguggauuccagguggu

SEQ ID NO: 210637 - RNA, 22 nt, Homo sapiens
uccuccucuaccucaucccagu

SEQ ID NO: 210638 - RNA, 22 nt, Homo sapiens
ugagggguuuggaaugggaugg

SEQ ID NO: 210639 - RNA, 21 nt, Homo sapiens
auccaguucucugagggggcu

SEQ ID NO: 210640 - RNA, 22 nt, Homo sapiens
aaccccuaaggcaacuggaugg

SEQ ID NO: 210641 - RNA, 21 nt, Homo sapiens
ucauccucgucucccucccag

SEQ ID NO: 210642 - RNA, 22 nt, Homo sapiens
agggaaggggacgaggguuggg

SEQ ID NO: 210643 - RNA, 23 nt, Homo sapiens
aagaagagacugagucaucgaau

SEQ ID NO: 210644 - RNA, 23 nt, Homo sapiens
caauggcacaaacucauucuuga

SEQ ID NO: 210645 - RNA, 19 nt, Homo sapiens
guccuaggaggcuccucug

SEQ ID NO: 210646 - RNA, 21 nt, Homo sapiens
caauucucaaaggagccuccc

SEQ ID NO: 210647 - RNA, 21 nt, Homo sapiens
guuggggugcaggggucugcu

SEQ ID NO: 210648 - RNA, 22 nt, Homo sapiens
uuagcuuaaggaguaccagauc

SEQ ID NO: 210649 - RNA, 21 nt, Homo sapiens
uaugguacuccuuaagcuaac

SEQ ID NO: 210650 - RNA, 22 nt, Homo sapiens
cacauaugaagugagccagcac

SEQ ID NO: 210651 - RNA, 22 nt, Homo sapiens
ugcuggcucauuucauaugugu

SEQ ID NO: 210652 - RNA, 22 nt, Homo sapiens
uuccaugccuccuagaaguucc

SEQ ID NO: 210653 - RNA, 22 nt, Homo sapiens
agccuuccaggagaaauggaga

SEQ ID NO: 210654 - RNA, 22 nt, Homo sapiens
uaaaacuuuaagugugccuagg

SEQ ID NO: 210655 - RNA, 22 nt, Homo sapiens
uaggcacacuuaaaguuauagc

SEQ ID NO: 210656 - RNA, 22 nt, Homo sapiens
gaauauggguauauuaguuugg

SEQ ID NO: 210657 - RNA, 22 nt, Homo sapiens
aaacuaauauacccauauucug

SEQ ID NO: 210658 - RNA, 22 nt, Homo sapiens
uaguucuucccuuugcccaauu

SEQ ID NO: 210659 - RNA, 22 nt, Homo sapiens
cagggaaaugggaagaacuaga

SEQ ID NO: 210660 - RNA, 22 nt, Homo sapiens
cugaauagcugggacuacaggu

SEQ ID NO: 210661 - RNA, 22 nt, Homo sapiens
ugaaguaccagcuacucgagag

SEQ ID NO: 210662 - RNA, 22 nt, Homo sapiens
cagagugacaagcugguuaaag

SEQ ID NO: 210663 - RNA, 22 nt, Homo sapiens
uauccagcuuguuacuauaugc

SEQ ID NO: 210664 - RNA, 21 nt, Homo sapiens
gccccgggcagugugaucauc

SEQ ID NO: 210665 - RNA, 18 nt, Homo sapiens
auggucaccuccgggacu

SEQ ID NO: 210666 - RNA, 19 nt, Homo sapiens
aagucccacuaaugccagc

SEQ ID NO: 210667 - RNA, 21 nt, Homo sapiens
acuggcauuagugggacuuuu

SEQ ID NO: 210668 - RNA, 23 nt, Homo sapiens
ugcacauggcaaccuagcuccca

SEQ ID NO: 210669 - RNA, 21 nt, Homo sapiens
ggcugggugcucuugugcagu

SEQ ID NO: 210670 - RNA, 21 nt, Homo sapiens
aauaaaguucauguauggcaa

SEQ ID NO: 210671 - RNA, 21 nt, Homo sapiens
uugccauacauagacuuuauu

SEQ ID NO: 210672 - RNA, 21 nt, Homo sapiens
auacccauagcuuagcuccca

SEQ ID NO: 210673 - RNA, 21 nt, Homo sapiens
ugggagcuaagcuauggguau

SEQ ID NO: 210674 - RNA, 22 nt, Homo sapiens
gagaaaugcuggacuaaucugc

SEQ ID NO: 210675 - RNA, 22 nt, Homo sapiens
agaaaggguggcaauaccucuu

SEQ ID NO: 210676 - RNA, 22 nt, Homo sapiens
agguauugccacccuuucuagu

SEQ ID NO: 210677 - RNA, 22 nt, Homo sapiens
guagcaccuugcaggauaaggu

SEQ ID NO: 210678 - RNA, 24 nt, Homo sapiens
uacagaugcagauucucugacuuc

SEQ ID NO: 210679 - RNA, 20 nt, Homo sapiens
aacucuagccugagcaacag

SEQ ID NO: 210680 - RNA, 22 nt, Homo sapiens
acagcccagcaguuaucacggg

SEQ ID NO: 210681 - RNA, 21 nt, Homo sapiens
uaucguaucguauuguauugu

SEQ ID NO: 210682 - RNA, 22 nt, Homo sapiens
uuagaacguuuuagggucaaau

SEQ ID NO: 210683 - RNA, 22 nt, Homo sapiens
uaacaaacaccuguaaaacagc

SEQ ID NO: 210684 - RNA, 22 nt, Homo sapiens
agcauacaccuguaguccuaga

SEQ ID NO: 210685 - RNA, 21 nt, Homo sapiens
ucagcuacuaccucuauuagg

SEQ ID NO: 210686 - RNA, 22 nt, Homo sapiens
uugcucugagcuccgagaaagc

SEQ ID NO: 210687 - RNA, 22 nt, Homo sapiens
caaauaauaccacagugggugu

SEQ ID NO: 210688 - RNA, 20 nt, Homo sapiens
aauaauaucacaguaggugu

SEQ ID NO: 210689 - RNA, 22 nt, Homo sapiens
aauaauaucacaguagguguac

SEQ ID NO: 210690 - RNA, 22 nt, Homo sapiens
gcaguggcucugaaaugaacuc

SEQ ID NO: 210691 - RNA, 21 nt, Homo sapiens
cagaucaugggacugucucag

SEQ ID NO: 210692 - RNA, 22 nt, Homo sapiens
acuccaagaagaaucuagacag

SEQ ID NO: 210693 - RNA, 22 nt, Homo sapiens
cucauuuaaguagucugaugcc

SEQ ID NO: 210694 - RNA, 22 nt, Homo sapiens
ucaaguaguuucaugauaaagg

SEQ ID NO: 210695 - RNA, 22 nt, Homo sapiens
ugggggagugcagugauugugg

SEQ ID NO: 210696 - RNA, 22 nt, Homo sapiens
uccugucuuuccuuguuggagc

SEQ ID NO: 210697 - RNA, 22 nt, Homo sapiens
uaaugcauuaaauuauugaagg

SEQ ID NO: 210698 - RNA, 19 nt, Homo sapiens
uuauugucacguucugauu

SEQ ID NO: 210699 - RNA, 22 nt, Homo sapiens
ugagucagcaacauaucccaug

SEQ ID NO: 210700 - RNA, 18 nt, Homo sapiens
aggagaagucgggaaggu

SEQ ID NO: 210701 - RNA, 22 nt, Homo sapiens
uuaggccaucaucccauuaugc

SEQ ID NO: 210702 - RNA, 23 nt, Homo sapiens
uguuucggggcucauggccugug

SEQ ID NO: 210703 - RNA, 22 nt, Homo sapiens
uucuggauaacaugcugaagcu

SEQ ID NO: 210704 - RNA, 22 nt, Homo sapiens
acguuugaaugcuguacaaggc

SEQ ID NO: 210705 - RNA, 20 nt, Homo sapiens
augagcgacugugccugacc

SEQ ID NO: 210706 - RNA, 20 nt, Homo sapiens
gcggagagagaauggggagc

SEQ ID NO: 210707 - RNA, 20 nt, Homo sapiens
gggcuggggcgcggggaggu

SEQ ID NO: 210708 - RNA, 21 nt, Homo sapiens
ccugcgagucuccggcggugg

SEQ ID NO: 210709 - RNA, 21 nt, Homo sapiens
gggcuagggccugcugccccc

SEQ ID NO: 210710 - RNA, 19 nt, Homo sapiens
ccgguuccagucccuggag

SEQ ID NO: 210711 - RNA, 19 nt, Homo sapiens
uucugcugccggccaaggc

SEQ ID NO: 210712 - RNA, 22 nt, Homo sapiens
uccucaucacacugcaccuuag

SEQ ID NO: 210713 - RNA, 20 nt, Homo sapiens
gguagugaguuaucagcuac

SEQ ID NO: 210714 - RNA, 20 nt, Homo sapiens
gauauucagaggcuaggugg

SEQ ID NO: 210715 - RNA, 21 nt, Homo sapiens
acggcccaggcggcauuggug

SEQ ID NO: 210716 - RNA, 21 nt, Homo sapiens
agcaugacagaggagaggugg

SEQ ID NO: 210717 - RNA, 21 nt, Homo sapiens
gggaagagcuguacggccuuc

SEQ ID NO: 210718 - RNA, 19 nt, Homo sapiens
ccgccugagcuagcugugg

SEQ ID NO: 210719 - RNA, 24 nt, Homo sapiens
uuggaagcuuggaccaacuagcug

SEQ ID NO: 210720 - RNA, 19 nt, Homo sapiens
ucuagugcgggcguucccg

SEQ ID NO: 210721 - RNA, 24 nt, Homo sapiens
aggagcagugccggccaaggcgcc

SEQ ID NO: 210722 - RNA, 19 nt, Homo sapiens
gaauacgucugguugaucc

SEQ ID NO: 210723 - RNA, 20 nt, Homo sapiens
cuuauaucagaggcuguggg

SEQ ID NO: 210724 - RNA, 20 nt, Homo sapiens
uuccgccagucgguggccgg

SEQ ID NO: 210725 - RNA, 19 nt, Homo sapiens
aaggggcugggggagcaca

SEQ ID NO: 210726 - RNA, 20 nt, Homo sapiens
ggagguugggaagggcagag

SEQ ID NO: 210727 - RNA, 18 nt, Homo sapiens
ugaggcgggggggcgagc

SEQ ID NO: 210728 - RNA, 20 nt, Homo sapiens
agagaugaagcgggggggcg

SEQ ID NO: 210729 - RNA, 24 nt, Homo sapiens
ggaggccgggguggggcggggcgg

SEQ ID NO: 210730 - RNA, 19 nt, Homo sapiens
ggggagcgaggggcggggc

SEQ ID NO: 210731 - RNA, 20 nt, Homo sapiens
gggaaaaggaagggggagga

SEQ ID NO: 210732 - RNA, 20 nt, Homo sapiens
gcggaaggcggagcggcgga

SEQ ID NO: 210733 - RNA, 18 nt, Homo sapiens
gugaaggcccggcggaga

SEQ ID NO: 210734 - RNA, 19 nt, Homo sapiens
ugagggagugggugggagg

SEQ ID NO: 210735 - RNA, 19 nt, Homo sapiens
acuggaauuggagucaaaa

SEQ ID NO: 210736 - RNA, 19 nt, Homo sapiens
ugagggaguuggguguaua

SEQ ID NO: 210737 - RNA, 19 nt, Homo sapiens
ugagggaguggauuguaug

SEQ ID NO: 210738 - RNA, 19 nt, Homo sapiens
ggcuggucagaugggagug

SEQ ID NO: 210739 - RNA, 19 nt, Homo sapiens
agcagggcuggggauugca

SEQ ID NO: 210740 - RNA, 19 nt, Homo sapiens
ugagggaggagguugggua

SEQ ID NO: 210741 - RNA, 19 nt, Homo sapiens
ugaggugguaggauguaga

SEQ ID NO: 210742 - RNA, 19 nt, Homo sapiens
cagcaggaggugaggggag

SEQ ID NO: 210743 - RNA, 22 nt, Homo sapiens
agcaguguuuguuuugcccaca

SEQ ID NO: 210744 - RNA, 22 nt, Homo sapiens
ucgggcgcaagagcacugcagu

SEQ ID NO: 210745 - RNA, 21 nt, Homo sapiens
acacuuguugggaugaccugc

SEQ ID NO: 210746 - RNA, 24 nt, Homo sapiens
aggagcuauccacuccaggugucc

SEQ ID NO: 210747 - RNA, 23 nt, Homo sapiens
ccagagcagccugcgguaacagu

SEQ ID NO: 210748 - RNA, 22 nt, Homo sapiens
aguugccagggcugccuuuggu

SEQ ID NO: 210749 - RNA, 21 nt, Homo sapiens
uagaccaucuuucuagaguau

SEQ ID NO: 210750 - RNA, 22 nt, Homo sapiens
agcucuagaaagauuguugacc

SEQ ID NO: 210751 - RNA, 21 nt, Homo sapiens
gggacuaggaugcagaccucc

SEQ ID NO: 210752 - RNA, 23 nt, Homo sapiens
aggucugcauucaaauccccaga

SEQ ID NO: 210753 - RNA, 20 nt, Homo sapiens
cauuacagcacagccauucu

SEQ ID NO: 210754 - RNA, 21 nt, Homo sapiens
ucuggcugugcuguaaugcag

SEQ ID NO: 210755 - RNA, 21 nt, Homo sapiens
ugacuucuaccucuuccaaag

SEQ ID NO: 210756 - RNA, 22 nt, Homo sapiens
uuggaauaggggauaucucagc

SEQ ID NO: 210757 - RNA, 22 nt, Homo sapiens
ucguaucagagauuccagacac

SEQ ID NO: 210758 - RNA, 23 nt, Homo sapiens
acugggaugucacugaauauggu

SEQ ID NO: 210759 - RNA, 22 nt, Homo sapiens
caaaguccuuccuauuuuuccc

SEQ ID NO: 210760 - RNA, 21 nt, Homo sapiens
gaagaauaggagggacuuugu

SEQ ID NO: 210761 - RNA, 22 nt, Homo sapiens
ugggccaugcauuucuagaacu

SEQ ID NO: 210762 - RNA, 21 nt, Homo sapiens
ucuagaaaugcaugacccacc

SEQ ID NO: 210763 - RNA, 22 nt, Homo sapiens
uuccacugccacuaccuaauuu

SEQ ID NO: 210764 - RNA, 21 nt, Homo sapiens
auuagguaguggcaguggaac

SEQ ID NO: 210765 - RNA, 21 nt, Homo sapiens
caccgacucugucuccugcag

SEQ ID NO: 210766 - RNA, 22 nt, Homo sapiens
cagcaggggagagagaggaguc

SEQ ID NO: 210767 - RNA, 22 nt, Homo sapiens
ccucaccaucccuucugccugc

SEQ ID NO: 210768 - RNA, 23 nt, Homo sapiens
caggcagaaguggggcugacagg

SEQ ID NO: 210769 - RNA, 23 nt, Homo sapiens
ccucaccaccccuucugccugca

SEQ ID NO: 210770 - RNA, 24 nt, Homo sapiens
cugcaggcagaaguggggcugaca

SEQ ID NO: 210771 - RNA, 22 nt, Homo sapiens
uuccagcccuucuaaugguagg

SEQ ID NO: 210772 - RNA, 22 nt, Homo sapiens
uaccauuagaagagcuggaaga

SEQ ID NO: 210773 - RNA, 21 nt, Homo sapiens
ucaagugucaucugucccuag

SEQ ID NO: 210774 - RNA, 23 nt, Homo sapiens
uuugggauugacgccacaugucu

SEQ ID NO: 210775 - RNA, 21 nt, Homo sapiens
cugccuguucuuccacuccag

SEQ ID NO: 210776 - RNA, 23 nt, Homo sapiens
uauggaguggacuuucagcuggc

SEQ ID NO: 210777 - RNA, 20 nt, Homo sapiens
ucucuucaucuaccccccag

SEQ ID NO: 210778 - RNA, 21 nt, Homo sapiens
uuggaggguguggaagacauc

SEQ ID NO: 210779 - RNA, 21 nt, Homo sapiens
ccaaaccagucgugccugugg

SEQ ID NO: 210780 - RNA, 22 nt, Homo sapiens
cucaaaccggcugugccugugg

SEQ ID NO: 210781 - RNA, 21 nt, Homo sapiens
acaggcacgacugguuuggca

SEQ ID NO: 210782 - RNA, 22 nt, Homo sapiens
uccgaacucuccauuccucugc

SEQ ID NO: 210783 - RNA, 20 nt, Homo sapiens
ugggaauggggguaagggcc

SEQ ID NO: 210784 - RNA, 22 nt, Homo sapiens
aggcgauguggggauguagaga

SEQ ID NO: 210785 - RNA, 21 nt, Homo sapiens
uaguggucagagggcuuauga

SEQ ID NO: 210786 - RNA, 22 nt, Homo sapiens
ucugacaucagugauucuccug

SEQ ID NO: 210787 - RNA, 22 nt, Homo sapiens
cgcgccugcaggaacugguaga

SEQ ID NO: 210788 - RNA, 23 nt, Homo sapiens
ugggcaggggcuuauuguaggag

SEQ ID NO: 210789 - RNA, 22 nt, Homo sapiens
ugcaggggucgggugggccagg

SEQ ID NO: 210790 - RNA, 20 nt, Homo sapiens
aggcgcacccgaccacaugc

SEQ ID NO: 210791 - RNA, 22 nt, Homo sapiens
auaguccgaguaacgucggggc

SEQ ID NO: 210792 - RNA, 23 nt, Homo sapiens
cugggcccgcggcgggcgugggg

SEQ ID NO: 210793 - RNA, 22 nt, Homo sapiens
cuguacagccuccuagcuuucc

SEQ ID NO: 210794 - RNA, 21 nt, Homo sapiens
cuauacaaucuacugucuuuc

SEQ ID NO: 210795 - RNA, 22 nt, Homo sapiens
ugagguaguagguuguauaguu

SEQ ID NO: 210796 - RNA, 22 nt, Homo sapiens
cuauacaaccuacugccuuccc

SEQ ID NO: 210797 - RNA, 22 nt, Homo sapiens
ugagguaguagguugugugguu

SEQ ID NO: 210798 - RNA, 22 nt, Homo sapiens
ugagguaguagguuguaugguu

SEQ ID NO: 210799 - RNA, 22 nt, Homo sapiens
cuauacgaccugcugccuuucu

SEQ ID NO: 210800 - RNA, 22 nt, Homo sapiens
agagguaguagguugcauaguu

SEQ ID NO: 210801 - RNA, 22 nt, Homo sapiens
cuauacggccuccuagcuuucc

SEQ ID NO: 210802 - RNA, 22 nt, Homo sapiens
ugagguaggagguuguauaguu

SEQ ID NO: 210803 - RNA, 22 nt, Homo sapiens
cuauacaaucuauugccuuccc

SEQ ID NO: 210804 - RNA, 22 nt, Homo sapiens
cuauacagucuacugucuuucc

SEQ ID NO: 210805 - RNA, 22 nt, Homo sapiens
ugagguaguagauuguauaguu

SEQ ID NO: 210806 - RNA, 21 nt, Homo sapiens
cuguacaggccacugccuugc

SEQ ID NO: 210807 - RNA, 22 nt, Homo sapiens
ugagguaguaguuuguacaguu

SEQ ID NO: 210808 - RNA, 22 nt, Homo sapiens
cugcgcaagcuacugccuugcu

SEQ ID NO: 210809 - RNA, 22 nt, Homo sapiens
ugagguaguaguuugugcuguu

SEQ ID NO: 210810 - RNA, 22 nt, Homo sapiens
auacauacuucuuuacauucca

SEQ ID NO: 210811 - RNA, 22 nt, Homo sapiens
uauuccccuagauacgaauuug

SEQ ID NO: 210812 - RNA, 23 nt, Homo sapiens
cacaaauucggaucuacagggua

SEQ ID NO: 210813 - RNA, 22 nt, Homo sapiens
auuccccuagaaucgaaucugu

SEQ ID NO: 210814 - RNA, 23 nt, Homo sapiens
cacaaauucgguucuacagggua

SEQ ID NO: 210815 - RNA, 22 nt, Homo sapiens
ugaggcagcacaauauggccug

SEQ ID NO: 210816 - RNA, 22 nt, Homo sapiens
cacaaaccauuaugugcugcua

SEQ ID NO: 210817 - RNA, 22 nt, Homo sapiens
uagagcagcaaauaaugauucg

SEQ ID NO: 210818 - RNA, 22 nt, Homo sapiens
uguaaaccaugaugugcugcua

SEQ ID NO: 210819 - RNA, 22 nt, Homo sapiens
ucagcagcacaguuaauacugg

SEQ ID NO: 210820 - RNA, 22 nt, Homo sapiens
uaaagcagcacaguaauauugg

SEQ ID NO: 210821 - RNA, 22 nt, Homo sapiens
cgccaauauuuacgugcugcua

SEQ ID NO: 210822 - RNA, 22 nt, Homo sapiens
cuacaagugccuucacugcagu

SEQ ID NO: 210823 - RNA, 23 nt, Homo sapiens
cuaccugcacuguaagcacuuug

SEQ ID NO: 210824 - RNA, 23 nt, Homo sapiens
ccagaaggagcacuuagggcagu

SEQ ID NO: 210825 - RNA, 23 nt, Homo sapiens
cuaucugcacuagaugcaccuua

SEQ ID NO: 210826 - RNA, 22 nt, Homo sapiens
gccagaaggggcauuuagggca

SEQ ID NO: 210827 - RNA, 23 nt, Homo sapiens
cuaacugcacuagaugcaccuua

SEQ ID NO: 210828 - RNA, 23 nt, Homo sapiens
ucaguuuugcauagauuugcaca

SEQ ID NO: 210829 - RNA, 22 nt, Homo sapiens
uguagugcaacuaugcaaaacu

SEQ ID NO: 210830 - RNA, 23 nt, Homo sapiens
gcuggaugcaaaccugcaaaacu

SEQ ID NO: 210831 - RNA, 22 nt, Homo sapiens
ugaaaugcaaaccugcaaaacu

SEQ ID NO: 210832 - RNA, 23 nt, Homo sapiens
ucaguuuugcauggauuugcaca

SEQ ID NO: 210833 - RNA, 22 nt, Homo sapiens
cuuuaagugcucauaaugcagu

SEQ ID NO: 210834 - RNA, 23 nt, Homo sapiens
cuaccugcacuauaagcacuuua

SEQ ID NO: 210835 - RNA, 22 nt, Homo sapiens
cuggaagugcccauacuacagu

SEQ ID NO: 210836 - RNA, 23 nt, Homo sapiens
cuaccugcacuaugagcacuuug

SEQ ID NO: 210837 - RNA, 21 nt, Homo sapiens
acagcccaucgacugguguug

SEQ ID NO: 210838 - RNA, 22 nt, Homo sapiens
ucaacaucagucugauaagcua

SEQ ID NO: 210839 - RNA, 22 nt, Homo sapiens
acaguucuucaacuggcagcuu

SEQ ID NO: 210840 - RNA, 22 nt, Homo sapiens
uaaagcuugccacugaagaacu

SEQ ID NO: 210841 - RNA, 21 nt, Homo sapiens
ggaaaucccuggcaaugugau

SEQ ID NO: 210842 - RNA, 22 nt, Homo sapiens
aaaucccauccccaggaacccc

SEQ ID NO: 210843 - RNA, 21 nt, Homo sapiens
gguaaucccuggcaaugugau

SEQ ID NO: 210844 - RNA, 22 nt, Homo sapiens
aaaucagcaugccaggaaccca

SEQ ID NO: 210845 - RNA, 22 nt, Homo sapiens
ggguaaucacuggcaaugugau

SEQ ID NO: 210846 - RNA, 22 nt, Homo sapiens
acugauaucagcucaguaggca

SEQ ID NO: 210847 - RNA, 22 nt, Homo sapiens
cuguguuucagcucaguaggca

SEQ ID NO: 210848 - RNA, 22 nt, Homo sapiens
cuguuccugcugaacugagcca

SEQ ID NO: 210849 - RNA, 22 nt, Homo sapiens
ucagaccgagacaagugcaaug

SEQ ID NO: 210850 - RNA, 21 nt, Homo sapiens
caauugcccaagucuccgccu

SEQ ID NO: 210851 - RNA, 22 nt, Homo sapiens
cgugcaaguaaccaagaauagg

SEQ ID NO: 210852 - RNA, 22 nt, Homo sapiens
gaaacaaguaaucaagaauagg

SEQ ID NO: 210853 - RNA, 22 nt, Homo sapiens
agccuauccuggauuacuugaa

SEQ ID NO: 210854 - RNA, 22 nt, Homo sapiens
gagccaaguaauggagaacagg

SEQ ID NO: 210855 - RNA, 21 nt, Homo sapiens
accuauccugaauuacuugaa

SEQ ID NO: 210856 - RNA, 21 nt, Homo sapiens
gcggaacuuagccacugugaa

SEQ ID NO: 210857 - RNA, 22 nt, Homo sapiens
ugcucacaagcagcuaagcccu

SEQ ID NO: 210858 - RNA, 21 nt, Homo sapiens
gcagaacuuagccacugugaa

SEQ ID NO: 210859 - RNA, 22 nt, Homo sapiens
guucaccaaucagcuaagcucu

SEQ ID NO: 210860 - RNA, 22 nt, Homo sapiens
uccaggagcucacaaucuagug

SEQ ID NO: 210861 - RNA, 22 nt, Homo sapiens
cucaauagacugugagcuccuu

SEQ ID NO: 210862 - RNA, 22 nt, Homo sapiens
uaaccgauuucagauggugcua

SEQ ID NO: 210863 - RNA, 22 nt, Homo sapiens
cugaacaccaaaagaaaucagu

SEQ ID NO: 210864 - RNA, 24 nt, Homo sapiens
ucuaaaccaccauaugaaaccagc

SEQ ID NO: 210865 - RNA, 22 nt, Homo sapiens
cuaagccaccaugugaaaccag

SEQ ID NO: 210866 - RNA, 23 nt, Homo sapiens
aacacugauuucaaauggugcua

SEQ ID NO: 210867 - RNA, 22 nt, Homo sapiens
uaaccgauuucaaauggugcua

SEQ ID NO: 210868 - RNA, 22 nt, Homo sapiens
gaacaccaggagaaaucgguca

SEQ ID NO: 210869 - RNA, 22 nt, Homo sapiens
gcugcaaacauccgacugaaag

SEQ ID NO: 210870 - RNA, 22 nt, Homo sapiens
cuuccagucgaggauguuuaca

SEQ ID NO: 210871 - RNA, 22 nt, Homo sapiens
gaaguaaacauccaccucccag

SEQ ID NO: 210872 - RNA, 22 nt, Homo sapiens
agcugaguguaggauguuuaca

SEQ ID NO: 210873 - RNA, 22 nt, Homo sapiens
ggaguaaacaacccucucccag

SEQ ID NO: 210874 - RNA, 22 nt, Homo sapiens
agaguaaacagccuucucccag

SEQ ID NO: 210875 - RNA, 23 nt, Homo sapiens
gcugagaguguaggauguuuaca

SEQ ID NO: 210876 - RNA, 22 nt, Homo sapiens
gcagcaaacaucugacugaaag

SEQ ID NO: 210877 - RNA, 22 nt, Homo sapiens
cuuccagucggggauguuuaca

SEQ ID NO: 210878 - RNA, 22 nt, Homo sapiens
gcuguaaacauccgacugaaag

SEQ ID NO: 210879 - RNA, 22 nt, Homo sapiens
cuuccagucaaggauguuuaca

SEQ ID NO: 210880 - RNA, 22 nt, Homo sapiens
auggcaauauguuggcauagca

SEQ ID NO: 210881 - RNA, 21 nt, Homo sapiens
agcuaugccagcaucuugccu

SEQ ID NO: 210882 - RNA, 22 nt, Homo sapiens
aaauaucacacacacuaaauug

SEQ ID NO: 210883 - RNA, 22 nt, Homo sapiens
ugcaacuuaguaaugugcaaua

SEQ ID NO: 210884 - RNA, 22 nt, Homo sapiens
agggcaguauacuugcugauug

SEQ ID NO: 210885 - RNA, 22 nt, Homo sapiens
acaaccagcuaagacacugcca

SEQ ID NO: 210886 - RNA, 22 nt, Homo sapiens
auggcaguggaguuagugauug

SEQ ID NO: 210887 - RNA, 23 nt, Homo sapiens
caaucagcuaaugacacugccua

SEQ ID NO: 210888 - RNA, 22 nt, Homo sapiens
ccuggccgugugguuagugauu

SEQ ID NO: 210889 - RNA, 23 nt, Homo sapiens
gcaaucagcuaacuacacugccu

SEQ ID NO: 210890 - RNA, 22 nt, Homo sapiens
uauggcagacugugauuuguug

SEQ ID NO: 210891 - RNA, 22 nt, Homo sapiens
uuagguagacugggauuuguug

SEQ ID NO: 210892 - RNA, 23 nt, Homo sapiens
acaacaaaaucacuagucuucca

SEQ ID NO: 210893 - RNA, 23 nt, Homo sapiens
agcauugcaaccgaucccaaccu

SEQ ID NO: 210894 - RNA, 22 nt, Homo sapiens
guaaugcaacaaauccccaccc

SEQ ID NO: 210895 - RNA, 22 nt, Homo sapiens
acaggccgggacaagugcaaua

SEQ ID NO: 210896 - RNA, 22 nt, Homo sapiens
ggaggccgggacgagugcaaua

SEQ ID NO: 210897 - RNA, 22 nt, Homo sapiens
cacugcaccgcgucccgucccu

SEQ ID NO: 210898 - RNA, 22 nt, Homo sapiens
cgggaagugcuagcucagcagu

SEQ ID NO: 210899 - RNA, 23 nt, Homo sapiens
cuaccugcacgaacagcacuuug

SEQ ID NO: 210900 - RNA, 22 nt, Homo sapiens
acuuucgguuaucuagcuuuau

SEQ ID NO: 210901 - RNA, 22 nt, Homo sapiens
ugcucaauaaauacccguugaa

SEQ ID NO: 210902 - RNA, 23 nt, Homo sapiens
ucauacagcuagauaaccaaaga

SEQ ID NO: 210903 - RNA, 22 nt, Homo sapiens
cauauuggcacugcacaugauu

SEQ ID NO: 210904 - RNA, 23 nt, Homo sapiens
agcaaaaaugugcuagugccaaa

SEQ ID NO: 210905 - RNA, 22 nt, Homo sapiens
gggaaaguaguaaguuguauag

SEQ ID NO: 210906 - RNA, 22 nt, Homo sapiens
aacaauacaacuuacuaccuca

SEQ ID NO: 210907 - RNA, 22 nt, Homo sapiens
cagacccauagaagcgagcuug

SEQ ID NO: 210908 - RNA, 22 nt, Homo sapiens
cacaagaucggaucuacggguu

SEQ ID NO: 210909 - RNA, 22 nt, Homo sapiens
cggacccacagacacgagcuug

SEQ ID NO: 210910 - RNA, 22 nt, Homo sapiens
cgcaaggucgguucuacgggug

SEQ ID NO: 210911 - RNA, 22 nt, Homo sapiens
cauaccuauagauacaagcuug

SEQ ID NO: 210912 - RNA, 22 nt, Homo sapiens
cacaaguucggaucuacggguu

SEQ ID NO: 210913 - RNA, 21 nt, Homo sapiens
uucaguuaucacaguacugua

SEQ ID NO: 210914 - RNA, 22 nt, Homo sapiens
agcaucagcacugugauaacug

SEQ ID NO: 210915 - RNA, 23 nt, Homo sapiens
caaggcagcacuguaaagaagcu

SEQ ID NO: 210916 - RNA, 23 nt, Homo sapiens
ucauagcccuguacaaugcugcu

SEQ ID NO: 210917 - RNA, 23 nt, Homo sapiens
agcagcauuguacagggcuauga

SEQ ID NO: 210918 - RNA, 22 nt, Homo sapiens
uagcacaugcucaaacauccgu

SEQ ID NO: 210919 - RNA, 23 nt, Homo sapiens
accacaggagucugagcauuuga

SEQ ID NO: 210920 - RNA, 22 nt, Homo sapiens
guaagaagugcuuacauugcag

SEQ ID NO: 210921 - RNA, 23 nt, Homo sapiens
cuaccugcacuguaagcacuuuu

SEQ ID NO: 210922 - RNA, 22 nt, Homo sapiens
gcagcaaguacccacagugcgg

SEQ ID NO: 210923 - RNA, 21 nt, Homo sapiens
aucugcacugucagcacuuua

SEQ ID NO: 210924 - RNA, 23 nt, Homo sapiens
ugauagcccuguacaaugcugcu

SEQ ID NO: 210925 - RNA, 22 nt, Homo sapiens
uauuuagugugauaauggcguu

SEQ ID NO: 210926 - RNA, 22 nt, Homo sapiens
caaacaccauugucacacucca

SEQ ID NO: 210927 - RNA, 20 nt, Homo sapiens
ggcauucaccgcgugccuua

SEQ ID NO: 210928 - RNA, 22 nt, Homo sapiens
aucaagguccgcugugaacacg

SEQ ID NO: 210929 - RNA, 22 nt, Homo sapiens
ggcucccaagaaccucaccugu

SEQ ID NO: 210930 - RNA, 24 nt, Homo sapiens
ucacagguuaaagggucucaggga

SEQ ID NO: 210931 - RNA, 22 nt, Homo sapiens
agcucccaagagccuaacccgu

SEQ ID NO: 210932 - RNA, 22 nt, Homo sapiens
gucccaagagccugacuuguga

SEQ ID NO: 210933 - RNA, 22 nt, Homo sapiens
ucacaaguuagggucucaggga

SEQ ID NO: 210934 - RNA, 22 nt, Homo sapiens
cgcauuauuacucacgguacga

SEQ ID NO: 210935 - RNA, 21 nt, Homo sapiens
cgcguaccaaaaguaauaaug

SEQ ID NO: 210936 - RNA, 22 nt, Homo sapiens
agccaagcucagacggauccga

SEQ ID NO: 210937 - RNA, 22 nt, Homo sapiens
aucagagcccucugagcuucag

SEQ ID NO: 210938 - RNA, 21 nt, Homo sapiens
aaagagaccgguucacuguga

SEQ ID NO: 210939 - RNA, 22 nt, Homo sapiens
auacuuuuugggguaagggcuu

SEQ ID NO: 210940 - RNA, 22 nt, Homo sapiens
augcuuuuugggguaagggcuu

SEQ ID NO: 210941 - RNA, 21 nt, Homo sapiens
gcaagcccagaccgcaaaaag

SEQ ID NO: 210942 - RNA, 22 nt, Homo sapiens
augcccuuuuaacauugcacug

SEQ ID NO: 210943 - RNA, 22 nt, Homo sapiens
gcagacaguagcacaaugugaa

SEQ ID NO: 210944 - RNA, 22 nt, Homo sapiens
augcccuuucaucauugcacug

SEQ ID NO: 210945 - RNA, 21 nt, Homo sapiens
guagugcaacagggaaagagu

SEQ ID NO: 210946 - RNA, 22 nt, Homo sapiens
cgaccauggcuguagacuguua

SEQ ID NO: 210947 - RNA, 22 nt, Homo sapiens
aguaacaaucgaaagccacggu

SEQ ID NO: 210948 - RNA, 22 nt, Homo sapiens
cagcugguugaaggggaccaaa

SEQ ID NO: 210949 - RNA, 22 nt, Homo sapiens
uagcugguugaaggggaccaaa

SEQ ID NO: 210950 - RNA, 22 nt, Homo sapiens
ccccucuggucaaccagucaca

SEQ ID NO: 210951 - RNA, 22 nt, Homo sapiens
cgccacggcuccaaucccuaua

SEQ ID NO: 210952 - RNA, 23 nt, Homo sapiens
ucacauaggaauaaaaagccaua

SEQ ID NO: 210953 - RNA, 22 nt, Homo sapiens
cccauggcuuuuagcccuacau

SEQ ID NO: 210954 - RNA, 23 nt, Homo sapiens
ucacauaggaaugaaaagccaua

SEQ ID NO: 210955 - RNA, 22 nt, Homo sapiens
agacucauuugagacgaugaug

SEQ ID NO: 210956 - RNA, 23 nt, Homo sapiens
uccaucaucaaaacaaauggagu

SEQ ID NO: 210957 - RNA, 23 nt, Homo sapiens
cuacgcguauucuuaagcaauaa

SEQ ID NO: 210958 - RNA, 22 nt, Homo sapiens
ggcccugguguugugaaguagc

SEQ ID NO: 210959 - RNA, 22 nt, Homo sapiens
aacccuggugucgugaaauagc

SEQ ID NO: 210960 - RNA, 23 nt, Homo sapiens
cggccugauucacaacaccagcu

SEQ ID NO: 210961 - RNA, 23 nt, Homo sapiens
acuccaacagggccgcgucucca

SEQ ID NO: 210962 - RNA, 23 nt, Homo sapiens
acuggagacacgugcacuguaga

SEQ ID NO: 210963 - RNA, 21 nt, Homo sapiens
ccgugguucuacccuguggua

SEQ ID NO: 210964 - RNA, 22 nt, Homo sapiens
cuaccauaggguaaaaccacug

SEQ ID NO: 210965 - RNA, 22 nt, Homo sapiens
ccaucuuuaccagacaguguua

SEQ ID NO: 210966 - RNA, 22 nt, Homo sapiens
uccaacacuguacuggaagaug

SEQ ID NO: 210967 - RNA, 23 nt, Homo sapiens
uccauaaaguaggaaacacuaca

SEQ ID NO: 210968 - RNA, 21 nt, Homo sapiens
aguagugcuuucuacuuuaug

SEQ ID NO: 210969 - RNA, 21 nt, Homo sapiens
gagcuacagugcuucaucuca

SEQ ID NO: 210970 - RNA, 22 nt, Homo sapiens
accagagaugcagcacugcacc

SEQ ID NO: 210971 - RNA, 20 nt, Homo sapiens
aguacaucaucuauacugua

SEQ ID NO: 210972 - RNA, 22 nt, Homo sapiens
cuuacaguauaugaugauaucc

SEQ ID NO: 210973 - RNA, 22 nt, Homo sapiens
agaacaguauuuccaggaaucc

SEQ ID NO: 210974 - RNA, 23 nt, Homo sapiens
agggauuccugggaaaacuggac

SEQ ID NO: 210975 - RNA, 22 nt, Homo sapiens
cugaagaacugaauuucagagg

SEQ ID NO: 210976 - RNA, 22 nt, Homo sapiens
aacccauggaauucaguucuca

SEQ ID NO: 210977 - RNA, 22 nt, Homo sapiens
ccagaacugaguccacagggca

SEQ ID NO: 210978 - RNA, 22 nt, Homo sapiens
agccuauggaauucaguucuca

SEQ ID NO: 210979 - RNA, 20 nt, Homo sapiens
gcagaagcauuuccacacac

SEQ ID NO: 210980 - RNA, 22 nt, Homo sapiens
uagcagaagcauuuccgcacac

SEQ ID NO: 210981 - RNA, 22 nt, Homo sapiens
acaaaguucuguagugcacuga

SEQ ID NO: 210982 - RNA, 22 nt, Homo sapiens
agucggagugucucagaacuuu

SEQ ID NO: 210983 - RNA, 22 nt, Homo sapiens
acaaaguucugugaugcacuga

SEQ ID NO: 210984 - RNA, 22 nt, Homo sapiens
gccugaguguauaacagaacuu

SEQ ID NO: 210985 - RNA, 21 nt, Homo sapiens
gcacagcccccgucccucccu

SEQ ID NO: 210986 - RNA, 23 nt, Homo sapiens
gggagugaagacacggagccaga

SEQ ID NO: 210987 - RNA, 22 nt, Homo sapiens
cugucccccaggccuguaccag

SEQ ID NO: 210988 - RNA, 22 nt, Homo sapiens
cacugguacaaggguugggaga

SEQ ID NO: 210989 - RNA, 21 nt, Homo sapiens
ccucaaggagcuucagucuag

SEQ ID NO: 210990 - RNA, 21 nt, Homo sapiens
acuagacugugagcuccucga

SEQ ID NO: 210991 - RNA, 18 nt, Homo sapiens
agacugugagcuccucga

SEQ ID NO: 210992 - RNA, 21 nt, Homo sapiens
ccaaguucugucaugcacuga

SEQ ID NO: 210993 - RNA, 22 nt, Homo sapiens
gaucacuuuugugacuaugcaa

SEQ ID NO: 210994 - RNA, 22 nt, Homo sapiens
aauaggucaaccguguaugauu

SEQ ID NO: 210995 - RNA, 22 nt, Homo sapiens
cgaaggcaacacggauaaccua

SEQ ID NO: 210996 - RNA, 22 nt, Homo sapiens
uguuaaugcuaauauguaggag

SEQ ID NO: 210997 - RNA, 23 nt, Homo sapiens
accccuaucacgauuagcauuaa

SEQ ID NO: 210998 - RNA, 22 nt, Homo sapiens
gguacagucaacggucaguggu

SEQ ID NO: 210999 - RNA, 22 nt, Homo sapiens
gguacaaucaacggucgauggu

SEQ ID NO: 211000 - RNA, 23 nt, Homo sapiens
acucaccgacagcguugaauguu

SEQ ID NO: 211001 - RNA, 21 nt, Homo sapiens
uugcauucauuguucagugag

SEQ ID NO: 211002 - RNA, 23 nt, Homo sapiens
acccaccgacagcaaugaauguu

SEQ ID NO: 211003 - RNA, 22 nt, Homo sapiens
guccacucaacggucgaugguu

SEQ ID NO: 211004 - RNA, 22 nt, Homo sapiens
acucaccgacagguugaauguu

SEQ ID NO: 211005 - RNA, 23 nt, Homo sapiens
acccaccgacaacaaugaauguu

SEQ ID NO: 211006 - RNA, 21 nt, Homo sapiens
uaguuggcaagucuagaacca

SEQ ID NO: 211007 - RNA, 24 nt, Homo sapiens
agugugaguucuaccauugccaaa

SEQ ID NO: 211008 - RNA, 22 nt, Homo sapiens
uuauggcccuucgguaauucac

SEQ ID NO: 211009 - RNA, 22 nt, Homo sapiens
agugaauucuaccagugccaua

SEQ ID NO: 211010 - RNA, 22 nt, Homo sapiens
acccuuaucaguucuccgucca

SEQ ID NO: 211011 - RNA, 22 nt, Homo sapiens
gaccagaggaaagccagccccu

SEQ ID NO: 211012 - RNA, 22 nt, Homo sapiens
ucaggaacugccuuucucucca

SEQ ID NO: 211013 - RNA, 22 nt, Homo sapiens
cccaaaaaauucaccuuugggc

SEQ ID NO: 211014 - RNA, 22 nt, Homo sapiens
agcccaaaaggagaauucuuug

SEQ ID NO: 211015 - RNA, 22 nt, Homo sapiens
ccggcugcaacacaagacacga

SEQ ID NO: 211016 - RNA, 22 nt, Homo sapiens
gcccggguccuguguuguagcc

SEQ ID NO: 211017 - RNA, 21 nt, Homo sapiens
ugcaaacccugcaugugggag

SEQ ID NO: 211018 - RNA, 21 nt, Homo sapiens
cccuccaccaugcaagggaug

SEQ ID NO: 211019 - RNA, 22 nt, Homo sapiens
accuaauauaucaaacauauca

SEQ ID NO: 211020 - RNA, 21 nt, Homo sapiens
aacccaauaucaaacauauca

SEQ ID NO: 211021 - RNA, 22 nt, Homo sapiens
ggggacgaaauccaagcgcagc

SEQ ID NO: 211022 - RNA, 23 nt, Homo sapiens
cagcugcuuuugggauuccguug

SEQ ID NO: 211023 - RNA, 22 nt, Homo sapiens
cugugaccuauggaauuggcag

SEQ ID NO: 211024 - RNA, 21 nt, Homo sapiens
ggcugucaauucauaggucag

SEQ ID NO: 211025 - RNA, 22 nt, Homo sapiens
acugggacuuuguaggccaguu

SEQ ID NO: 211026 - RNA, 22 nt, Homo sapiens
ucaucucgcccgcaaagaccca

SEQ ID NO: 211027 - RNA, 22 nt, Homo sapiens
agcgggacuuugagggccaguu

SEQ ID NO: 211028 - RNA, 22 nt, Homo sapiens
ucaucucgcccucaaaaccccg

SEQ ID NO: 211029 - RNA, 22 nt, Homo sapiens
cagauaacagcagccccacugg

SEQ ID NO: 211030 - RNA, 22 nt, Homo sapiens
uccacauggaguugcuguuaca

SEQ ID NO: 211031 - RNA, 22 nt, Homo sapiens
ggagcagcacagccaauauugg

SEQ ID NO: 211032 - RNA, 21 nt, Homo sapiens
gccaauauuucugugcugcua

SEQ ID NO: 211033 - RNA, 22 nt, Homo sapiens
cucaggcaguuucuuguugccg

SEQ ID NO: 211034 - RNA, 22 nt, Homo sapiens
cccaacaacaugaaacuaccua

SEQ ID NO: 211035 - RNA, 22 nt, Homo sapiens
gaaggcagugucgugcugucga

SEQ ID NO: 211036 - RNA, 22 nt, Homo sapiens
cccaacaacaggaaacuaccua

SEQ ID NO: 211037 - RNA, 22 nt, Homo sapiens
gcuggguggagaagguggugaa

SEQ ID NO: 211038 - RNA, 23 nt, Homo sapiens
ccucccacugcccucucuacccg

SEQ ID NO: 211039 - RNA, 22 nt, Homo sapiens
gaaccuaucuccccucuggacc

SEQ ID NO: 211040 - RNA, 22 nt, Homo sapiens
uaaccaaugugcagacuacugu

SEQ ID NO: 211041 - RNA, 23 nt, Homo sapiens
gaacagguagucugaacacuggg

SEQ ID NO: 211042 - RNA, 22 nt, Homo sapiens
uaaccaaugugcagacuacugu

SEQ ID NO: 211043 - RNA, 23 nt, Homo sapiens
gaacagauagucuaaacacuggg

SEQ ID NO: 211044 - RNA, 22 nt, Homo sapiens
acaucguuaccagacaguguua

SEQ ID NO: 211045 - RNA, 22 nt, Homo sapiens
uccagcacuguccgguaagaug

SEQ ID NO: 211046 - RNA, 22 nt, Homo sapiens
ucaucauuaccaggcaguauua

SEQ ID NO: 211047 - RNA, 22 nt, Homo sapiens
uccaaugcugcccaguaagaug

SEQ ID NO: 211048 - RNA, 23 nt, Homo sapiens
uccaucauuacccggcaguauua

SEQ ID NO: 211049 - RNA, 22 nt, Homo sapiens
ccaaacacugcuggguaagacg

SEQ ID NO: 211050 - RNA, 20 nt, Homo sapiens
uucccaugcccuauaccucu

SEQ ID NO: 211051 - RNA, 22 nt, Homo sapiens
caaagaaguauaugcauaggaa

SEQ ID NO: 211052 - RNA, 22 nt, Homo sapiens
cuagugguccuaaacauuucac

SEQ ID NO: 211053 - RNA, 23 nt, Homo sapiens
uccagugguucuuaacaguucaa

SEQ ID NO: 211054 - RNA, 22 nt, Homo sapiens
ugugaaauguuuaggaccacua

SEQ ID NO: 211055 - RNA, 21 nt, Homo sapiens
acgucccuuugccuucccagc

SEQ ID NO: 211056 - RNA, 22 nt, Homo sapiens
aggcauaggaugacaaagggaa

SEQ ID NO: 211057 - RNA, 21 nt, Homo sapiens
gaacuucacuccacugaaauc

SEQ ID NO: 211058 - RNA, 22 nt, Homo sapiens
cagacuccgguggaaugaagga

SEQ ID NO: 211059 - RNA, 22 nt, Homo sapiens
ccacacacuuccuuacauucca

SEQ ID NO: 211060 - RNA, 22 nt, Homo sapiens
acaagcuuuuugcucgucuuau

SEQ ID NO: 211061 - RNA, 22 nt, Homo sapiens
acaaaccuuuuguucgucuuau

SEQ ID NO: 211062 - RNA, 22 nt, Homo sapiens
ucagccgcugucacacgcacag

SEQ ID NO: 211063 - RNA, 21 nt, Homo sapiens
gcaccccuuugcugucccugc

SEQ ID NO: 211064 - RNA, 22 nt, Homo sapiens
aggcgaaggaugacaaagggaa

SEQ ID NO: 211065 - RNA, 21 nt, Homo sapiens
ggccgugacuggagacuguua

SEQ ID NO: 211066 - RNA, 23 nt, Homo sapiens
aguaagcagucuagagccaaggu

SEQ ID NO: 211067 - RNA, 22 nt, Homo sapiens
acugccugucugugccugcugu

SEQ ID NO: 211068 - RNA, 22 nt, Homo sapiens
gcacagcaaguguagacaggca

SEQ ID NO: 211069 - RNA, 21 nt, Homo sapiens
gucugucaauucauaggucau

SEQ ID NO: 211070 - RNA, 22 nt, Homo sapiens
auaaucccagagaccacuguga

SEQ ID NO: 211071 - RNA, 22 nt, Homo sapiens
ucacaguugccagcugagauua

SEQ ID NO: 211072 - RNA, 22 nt, Homo sapiens
ucacauuugccugcagagauuu

SEQ ID NO: 211073 - RNA, 23 nt, Homo sapiens
uccaaucaguuccugaugcagua

SEQ ID NO: 211074 - RNA, 22 nt, Homo sapiens
ccauggugcuugacggaaccau

SEQ ID NO: 211075 - RNA, 22 nt, Homo sapiens
cgcggugcuugacagaaccaug

SEQ ID NO: 211076 - RNA, 21 nt, Homo sapiens
acaugguuagaucaagcacaa

SEQ ID NO: 211077 - RNA, 22 nt, Homo sapiens
cgggacguccagacucaacucu

SEQ ID NO: 211078 - RNA, 22 nt, Homo sapiens
acagauguccagccacaauucu

SEQ ID NO: 211079 - RNA, 21 nt, Homo sapiens
agaauugcguuuggacaauca

SEQ ID NO: 211080 - RNA, 23 nt, Homo sapiens
gaaacccagcagacaauguagcu

SEQ ID NO: 211081 - RNA, 22 nt, Homo sapiens
aaaucuacauuguaugccaggu

SEQ ID NO: 211082 - RNA, 21 nt, Homo sapiens
acccaguagccagauguagcu

SEQ ID NO: 211083 - RNA, 22 nt, Homo sapiens
aggaucuacacuggcuacugag

SEQ ID NO: 211084 - RNA, 22 nt, Homo sapiens
ugggguauuugacaaacugaca

SEQ ID NO: 211085 - RNA, 22 nt, Homo sapiens
aacucagcuugucaaauacacg

SEQ ID NO: 211086 - RNA, 23 nt, Homo sapiens
uguagucacuagggcaccauuuu

SEQ ID NO: 211087 - RNA, 21 nt, Homo sapiens
aacggaaccacuagugacuug

SEQ ID NO: 211088 - RNA, 22 nt, Homo sapiens
ggagagccuccacccaacccuc

SEQ ID NO: 211089 - RNA, 21 nt, Homo sapiens
acaggauugagggggggcccu

SEQ ID NO: 211090 - RNA, 21 nt, Homo sapiens
caugcacaugcacacauacau

SEQ ID NO: 211091 - RNA, 24 nt, Homo sapiens
ugggagaaccucccugcuucugcu

SEQ ID NO: 211092 - RNA, 22 nt, Homo sapiens
aagcgguuuaccaucccacaua

SEQ ID NO: 211093 - RNA, 22 nt, Homo sapiens
auguaugugggacgguaaacca

SEQ ID NO: 211094 - RNA, 22 nt, Homo sapiens
agagagagucugcccuuguaua

SEQ ID NO: 211095 - RNA, 23 nt, Homo sapiens
gcuuugacaauacuauugcacug

SEQ ID NO: 211096 - RNA, 22 nt, Homo sapiens
aguagugcaauaaagucagagc

SEQ ID NO: 211097 - RNA, 23 nt, Homo sapiens
gcuuugacaauaucauugcacug

SEQ ID NO: 211098 - RNA, 23 nt, Homo sapiens
ucaccaaaacauggaagcacuua

SEQ ID NO: 211099 - RNA, 23 nt, Homo sapiens
agcaaguacauccacguuuaagu

SEQ ID NO: 211100 - RNA, 23 nt, Homo sapiens
cuacuaaaacauggaagcacuua

SEQ ID NO: 211101 - RNA, 22 nt, Homo sapiens
gaaagcacuuccauguuaaagu

SEQ ID NO: 211102 - RNA, 23 nt, Homo sapiens
ccacugaaacauggaagcacuua

SEQ ID NO: 211103 - RNA, 22 nt, Homo sapiens
cagcagguacccccauguuaaa

SEQ ID NO: 211104 - RNA, 23 nt, Homo sapiens
acacucaaacauggaagcacuua

SEQ ID NO: 211105 - RNA, 22 nt, Homo sapiens
gcaagugccuccauguuaaagu

SEQ ID NO: 211106 - RNA, 17 nt, Homo sapiens
aagcauggaagcacuua

SEQ ID NO: 211107 - RNA, 17 nt, Homo sapiens
aaacauggaagcaauua

SEQ ID NO: 211108 - RNA, 22 nt, Homo sapiens
ucgcccucucaacccagcuuuu

SEQ ID NO: 211109 - RNA, 22 nt, Homo sapiens
uugcccucucaacccagcuuuu

SEQ ID NO: 211110 - RNA, 20 nt, Homo sapiens
acccucucaacccagcuuuu

SEQ ID NO: 211111 - RNA, 19 nt, Homo sapiens
uccucucaacccagcuuuu

SEQ ID NO: 211112 - RNA, 18 nt, Homo sapiens
ccuucucaacccagcuuu

SEQ ID NO: 211113 - RNA, 21 nt, Homo sapiens
agaggucgaccguguaaugug

SEQ ID NO: 211114 - RNA, 22 nt, Homo sapiens
gcgaacgcgccacggaccaccu

SEQ ID NO: 211115 - RNA, 22 nt, Homo sapiens
aagaggucgaccguguauuggg

SEQ ID NO: 211116 - RNA, 23 nt, Homo sapiens
ugcgaacucaccacggacaaccu

SEQ ID NO: 211117 - RNA, 20 nt, Homo sapiens
ccagcagcaccuggggcagu

SEQ ID NO: 211118 - RNA, 23 nt, Homo sapiens
acaccaaugcccuaggggaugcg

SEQ ID NO: 211119 - RNA, 23 nt, Homo sapiens
acacuuacuggacaccuacuagg

SEQ ID NO: 211120 - RNA, 20 nt, Homo sapiens
cuggaggaagggcccagagg

SEQ ID NO: 211121 - RNA, 22 nt, Homo sapiens
acggaagggcagagagggccag

SEQ ID NO: 211122 - RNA, 22 nt, Homo sapiens
aaagagguuaaccagguguguu

SEQ ID NO: 211123 - RNA, 23 nt, Homo sapiens
ucucugcaggccgugugcuuugc

SEQ ID NO: 211124 - RNA, 22 nt, Homo sapiens
gccuaagacacaggcccagaga

SEQ ID NO: 211125 - RNA, 21 nt, Homo sapiens
uucuaggauaggcccaggggc

SEQ ID NO: 211126 - RNA, 22 nt, Homo sapiens
ggaucccugggaccauaccuag

SEQ ID NO: 211127 - RNA, 22 nt, Homo sapiens
ggucaggagcaauaaugaaaaa

SEQ ID NO: 211128 - RNA, 23 nt, Homo sapiens
acauuuuucguuauugcucuuga

SEQ ID NO: 211129 - RNA, 22 nt, Homo sapiens
gaagaaaggcaucauauaggag

SEQ ID NO: 211130 - RNA, 21 nt, Homo sapiens
aacuccuguaugaagccguuc

SEQ ID NO: 211131 - RNA, 22 nt, Homo sapiens
caacaaaaucacugaugcugga

SEQ ID NO: 211132 - RNA, 22 nt, Homo sapiens
cacucagcaccaggauauuguu

SEQ ID NO: 211133 - RNA, 23 nt, Homo sapiens
cggcucugucgucgaggcgcuca

SEQ ID NO: 211134 - RNA, 23 nt, Homo sapiens
cgugagcuccuggaggacaggga

SEQ ID NO: 211135 - RNA, 22 nt, Homo sapiens
gugaugcacuguggaaacauug

SEQ ID NO: 211136 - RNA, 21 nt, Homo sapiens
ugcaaugcaacuacaaugcac

SEQ ID NO: 211137 - RNA, 22 nt, Homo sapiens
gggcugcacugccgaggcacug

SEQ ID NO: 211138 - RNA, 20 nt, Homo sapiens
gcaaugcaacagcaaugcac

SEQ ID NO: 211139 - RNA, 22 nt, Homo sapiens
gcuauaaaguaacugagacgga

SEQ ID NO: 211140 - RNA, 22 nt, Homo sapiens
aaucagucucauugcuuuauaa

SEQ ID NO: 211141 - RNA, 23 nt, Homo sapiens
acgggugcgauuucugugugaga

SEQ ID NO: 211142 - RNA, 21 nt, Homo sapiens
ucaaucacagauagcaccccu

SEQ ID NO: 211143 - RNA, 22 nt, Homo sapiens
cuccagaccccucguucagggc

SEQ ID NO: 211144 - RNA, 22 nt, Homo sapiens
gagcccuggacuaggagucagc

SEQ ID NO: 211145 - RNA, 23 nt, Homo sapiens
agaggcaggcaugcgggcagaca

SEQ ID NO: 211146 - RNA, 23 nt, Homo sapiens
aaaucagaaucacaccuggggga

SEQ ID NO: 211147 - RNA, 22 nt, Homo sapiens
guaccccuggagauucugauaa

SEQ ID NO: 211148 - RNA, 22 nt, Homo sapiens
ugaauccuugaauagguguguu

SEQ ID NO: 211149 - RNA, 24 nt, Homo sapiens
acucacaccuagguuccaaggauu

SEQ ID NO: 211150 - RNA, 22 nt, Homo sapiens
uacagauggauaccgugcaauu

SEQ ID NO: 211151 - RNA, 22 nt, Homo sapiens
aaauugcaucgugauccacccg

SEQ ID NO: 211152 - RNA, 22 nt, Homo sapiens
auaaggauuuuuaggggcauua

SEQ ID NO: 211153 - RNA, 23 nt, Homo sapiens
cacaucugcccccaaaagucccu

SEQ ID NO: 211154 - RNA, 22 nt, Homo sapiens
auaaggauuuuuaggggcauua

SEQ ID NO: 211155 - RNA, 22 nt, Homo sapiens
acagcugccccugaaagucccu

SEQ ID NO: 211156 - RNA, 22 nt, Homo sapiens
ucaccauugcuaaagugcaauu

SEQ ID NO: 211157 - RNA, 22 nt, Homo sapiens
agaguugcauauuagcaacagu

SEQ ID NO: 211158 - RNA, 21 nt, Homo sapiens
aaagaucaaccauguauuauu

SEQ ID NO: 211159 - RNA, 22 nt, Homo sapiens
gcgaauauaacacggucgaucu

SEQ ID NO: 211160 - RNA, 22 nt, Homo sapiens
accagguuccaccccagcaggc

SEQ ID NO: 211161 - RNA, 23 nt, Homo sapiens
acacucaaaagauggcggcacuu

SEQ ID NO: 211162 - RNA, 20 nt, Homo sapiens
agugcccccacaguuugagu

SEQ ID NO: 211163 - RNA, 23 nt, Homo sapiens
gcacucaaacugugggggcacuu

SEQ ID NO: 211164 - RNA, 22 nt, Homo sapiens
aaagugccgccaucuuuugagu

SEQ ID NO: 211165 - RNA, 23 nt, Homo sapiens
acgcucaaaugucgcagcacuuu

SEQ ID NO: 211166 - RNA, 23 nt, Homo sapiens
acaccccaaaaucgaagcacuuc

SEQ ID NO: 211167 - RNA, 22 nt, Homo sapiens
ggaaagcgcccccauuuugagu

SEQ ID NO: 211168 - RNA, 22 nt, Homo sapiens
aauuacaauacaaucugauaag

SEQ ID NO: 211169 - RNA, 22 nt, Homo sapiens
cacuuaucagguuguauuauaa

SEQ ID NO: 211170 - RNA, 22 nt, Homo sapiens
aaugauaauacaaccugcuaag

SEQ ID NO: 211171 - RNA, 22 nt, Homo sapiens
cacuuagcagguuguauuauau

SEQ ID NO: 211172 - RNA, 22 nt, Homo sapiens
auauaauacaaccugcuaagug

SEQ ID NO: 211173 - RNA, 22 nt, Homo sapiens
agcacuuagcagguuguauuau

SEQ ID NO: 211174 - RNA, 22 nt, Homo sapiens
ucacgcgagccgaacgaacaaa

SEQ ID NO: 211175 - RNA, 21 nt, Homo sapiens
accauagaaggaaaaucuacc

SEQ ID NO: 211176 - RNA, 21 nt, Homo sapiens
acguggauuuuccucuaugau

SEQ ID NO: 211177 - RNA, 22 nt, Homo sapiens
uacucauagaaggagaaucuac

SEQ ID NO: 211178 - RNA, 22 nt, Homo sapiens
aacauggauuuuccucuaugau

SEQ ID NO: 211179 - RNA, 22 nt, Homo sapiens
aaacauagaaggaauauccacg

SEQ ID NO: 211180 - RNA, 21 nt, Homo sapiens
acguggaauuuccucuauguu

SEQ ID NO: 211181 - RNA, 21 nt, Homo sapiens
aacauagaaggaauauccacc

SEQ ID NO: 211182 - RNA, 22 nt, Homo sapiens
acaaaaguugccuuugugugau

SEQ ID NO: 211183 - RNA, 22 nt, Homo sapiens
gaauucaccaagggcaaccucu

SEQ ID NO: 211184 - RNA, 21 nt, Homo sapiens
ccuucugacuccaaguccagu

SEQ ID NO: 211185 - RNA, 22 nt, Homo sapiens
acacaggaccuggagucaggag

SEQ ID NO: 211186 - RNA, 19 nt, Homo sapiens
uucugccuccaaguccagu

SEQ ID NO: 211187 - RNA, 25 nt, Homo sapiens
ccacucuucugacuccaaguccagu

SEQ ID NO: 211188 - RNA, 20 nt, Homo sapiens
uuucugacuccaaguccagu

SEQ ID NO: 211189 - RNA, 19 nt, Homo sapiens
uccugacuccaaguccagu

SEQ ID NO: 211190 - RNA, 20 nt, Homo sapiens
cuucuggcuccaaguccagu

SEQ ID NO: 211191 - RNA, 20 nt, Homo sapiens
cuucugacuccaagcccagu

SEQ ID NO: 211192 - RNA, 21 nt, Homo sapiens
ccaucugacaccaaguccagu

SEQ ID NO: 211193 - RNA, 21 nt, Homo sapiens
ccuucugacuccuaguccagu

SEQ ID NO: 211194 - RNA, 19 nt, Homo sapiens
uucuggcuccaaauccagu

SEQ ID NO: 211195 - RNA, 22 nt, Homo sapiens
aguuaguggaccauguuacaua

SEQ ID NO: 211196 - RNA, 21 nt, Homo sapiens
ccuacguuccauagucuacca

SEQ ID NO: 211197 - RNA, 22 nt, Homo sapiens
aagauguggaccauauuacaua

SEQ ID NO: 211198 - RNA, 22 nt, Homo sapiens
gcgcauguucuauggucaacca

SEQ ID NO: 211199 - RNA, 22 nt, Homo sapiens
acagagagcuugcccuuguaua

SEQ ID NO: 211200 - RNA, 22 nt, Homo sapiens
auauacaaagggcaaccucgcu

SEQ ID NO: 211201 - RNA, 21 nt, Homo sapiens
aaguguuguccgugaaugauu

SEQ ID NO: 211202 - RNA, 22 nt, Homo sapiens
cgaauccaccacgaacaacuuc

SEQ ID NO: 211203 - RNA, 22 nt, Homo sapiens
agccacaaucaccuucugaucu

SEQ ID NO: 211204 - RNA, 20 nt, Homo sapiens
uaugaacaauuucuaggaau

SEQ ID NO: 211205 - RNA, 22 nt, Homo sapiens
agggguucaccgagcaacauuc

SEQ ID NO: 211206 - RNA, 23 nt, Homo sapiens
augcaaaguugcucggguaaccu

SEQ ID NO: 211207 - RNA, 21 nt, Homo sapiens
acaggccaucuguguuauauu

SEQ ID NO: 211208 - RNA, 22 nt, Homo sapiens
gguuaguggaccguguuacaua

SEQ ID NO: 211209 - RNA, 21 nt, Homo sapiens
cguacgcuauacggucuacua

SEQ ID NO: 211210 - RNA, 23 nt, Homo sapiens
acggcuaguggaccaggugaagu

SEQ ID NO: 211211 - RNA, 23 nt, Homo sapiens
gcgcccaauuaaugucuguugau

SEQ ID NO: 211212 - RNA, 22 nt, Homo sapiens
gccuucugacccuaaguccagu

SEQ ID NO: 211213 - RNA, 23 nt, Homo sapiens
acugaggggccucagaccgagcu

SEQ ID NO: 211214 - RNA, 23 nt, Homo sapiens
aaagucucgcucucugccccuca

SEQ ID NO: 211215 - RNA, 21 nt, Homo sapiens
auagcagcgccucacguuuug

SEQ ID NO: 211216 - RNA, 22 nt, Homo sapiens
uucaaaacaugaauugcugcug

SEQ ID NO: 211217 - RNA, 22 nt, Homo sapiens
gggcggacacgacauucccgau

SEQ ID NO: 211218 - RNA, 23 nt, Homo sapiens
ucaacgggagugaucgugucauu

SEQ ID NO: 211219 - RNA, 22 nt, Homo sapiens
acgguuuuaccagacaguauua

SEQ ID NO: 211220 - RNA, 22 nt, Homo sapiens
agaagcccugcaagacgaccug

SEQ ID NO: 211221 - RNA, 21 nt, Homo sapiens
ugcaugacggccugcaagaca

SEQ ID NO: 211222 - RNA, 21 nt, Homo sapiens
agacauggaggagccauccag

SEQ ID NO: 211223 - RNA, 23 nt, Homo sapiens
ccacccaaugaccuacuccaaga

SEQ ID NO: 211224 - RNA, 22 nt, Homo sapiens
acaccgaggagcccaucaugau

SEQ ID NO: 211225 - RNA, 22 nt, Homo sapiens
augggacauccuacauaugcaa

SEQ ID NO: 211226 - RNA, 22 nt, Homo sapiens
accagcuaacaauacacugcca

SEQ ID NO: 211227 - RNA, 22 nt, Homo sapiens
aguggcaggguaguuguggcug

SEQ ID NO: 211228 - RNA, 22 nt, Homo sapiens
gccagcuaacaauacacugccu

SEQ ID NO: 211229 - RNA, 23 nt, Homo sapiens
acagagaggagugcaacuagcaa

SEQ ID NO: 211230 - RNA, 25 nt, Homo sapiens
acagccgcuagcaauacacugccua

SEQ ID NO: 211231 - RNA, 22 nt, Homo sapiens
augaaugcaaaauguccccaau

SEQ ID NO: 211232 - RNA, 22 nt, Homo sapiens
auauuaggaacacaucgcaaaa

SEQ ID NO: 211233 - RNA, 22 nt, Homo sapiens
uauggaugcaaaaugaucccaa

SEQ ID NO: 211234 - RNA, 22 nt, Homo sapiens
uauucaggaacauauugcaaaa

SEQ ID NO: 211235 - RNA, 22 nt, Homo sapiens
aacucaguaaugguaacgguuu

SEQ ID NO: 211236 - RNA, 22 nt, Homo sapiens
aaugguaaugguucucuugcua

SEQ ID NO: 211237 - RNA, 22 nt, Homo sapiens
cacuuacuucuuugcagaugag

SEQ ID NO: 211238 - RNA, 22 nt, Homo sapiens
ucaguuuccucugcaaacaguu

SEQ ID NO: 211239 - RNA, 23 nt, Homo sapiens
acccuauaagcaauauugcacua

SEQ ID NO: 211240 - RNA, 22 nt, Homo sapiens
gcagagacaauauugauagggu

SEQ ID NO: 211241 - RNA, 21 nt, Homo sapiens
guguauaugcccauggacugc

SEQ ID NO: 211242 - RNA, 22 nt, Homo sapiens
cgauguaguccaaaggcacaua

SEQ ID NO: 211243 - RNA, 23 nt, Homo sapiens
auguguguugcguguauguguau

SEQ ID NO: 211244 - RNA, 21 nt, Homo sapiens
aagacgggaggagaggaguga

SEQ ID NO: 211245 - RNA, 22 nt, Homo sapiens
cucccuucuuuccucccgucuu

SEQ ID NO: 211246 - RNA, 22 nt, Homo sapiens
aucgggaggggacugagccuga

SEQ ID NO: 211247 - RNA, 22 nt, Homo sapiens
agagaggagagccguguaugac

SEQ ID NO: 211248 - RNA, 22 nt, Homo sapiens
gaauucaucacggccagccucu

SEQ ID NO: 211249 - RNA, 21 nt, Homo sapiens
auccuguacugagcugccccg

SEQ ID NO: 211250 - RNA, 22 nt, Homo sapiens
cucggggcagcucaguacagga

SEQ ID NO: 211251 - RNA, 22 nt, Homo sapiens
aacuggaugucccuguaugauu

SEQ ID NO: 211252 - RNA, 22 nt, Homo sapiens
aaguggaugacccuguacgauu

SEQ ID NO: 211253 - RNA, 21 nt, Homo sapiens
gaccaagaaauagccuuucaa

SEQ ID NO: 211254 - RNA, 21 nt, Homo sapiens
uugagagugccauuaucuggg

SEQ ID NO: 211255 - RNA, 22 nt, Homo sapiens
gcugccguauaugugaugucac

SEQ ID NO: 211256 - RNA, 22 nt, Homo sapiens
cagcauggaguccuccagguug

SEQ ID NO: 211257 - RNA, 20 nt, Homo sapiens
acccaccuggagauccaugg

SEQ ID NO: 211258 - RNA, 22 nt, Homo sapiens
guagaagggaaucuugcauaag

SEQ ID NO: 211259 - RNA, 22 nt, Homo sapiens
ccucauggaaggguuccccacu

SEQ ID NO: 211260 - RNA, 23 nt, Homo sapiens
aagaaucuugucccgcagguccu

SEQ ID NO: 211261 - RNA, 22 nt, Homo sapiens
ccuggcacacaguagaccuuca

SEQ ID NO: 211262 - RNA, 22 nt, Homo sapiens
aaugaaagccuaccauguacaa

SEQ ID NO: 211263 - RNA, 22 nt, Homo sapiens
gagguuucccguguauguuuca

SEQ ID NO: 211264 - RNA, 22 nt, Homo sapiens
aagaagugcaccauguuuguuu

SEQ ID NO: 211265 - RNA, 22 nt, Homo sapiens
cgaaaauaacaugggcaacuuc

SEQ ID NO: 211266 - RNA, 22 nt, Homo sapiens
gagauuggccauguaauacuca

SEQ ID NO: 211267 - RNA, 22 nt, Homo sapiens
ucuaacaccacagugugguuug

SEQ ID NO: 211268 - RNA, 21 nt, Homo sapiens
acaaaccacagugugcugcug

SEQ ID NO: 211269 - RNA, 23 nt, Homo sapiens
gaaaaacgcccccuggcuugaaa

SEQ ID NO: 211270 - RNA, 22 nt, Homo sapiens
cagaauccuugcccaggugcau

SEQ ID NO: 211271 - RNA, 23 nt, Homo sapiens
ucucacccagguagcaaggauua

SEQ ID NO: 211272 - RNA, 18 nt, Homo sapiens
acccagguagcaaggauu

SEQ ID NO: 211273 - RNA, 22 nt, Homo sapiens
agaauccuugcccgggugcauu

SEQ ID NO: 211274 - RNA, 22 nt, Homo sapiens
ucucacccagggacaaaggauu

SEQ ID NO: 211275 - RNA, 22 nt, Homo sapiens
ugaauccuugcccaggugcauu

SEQ ID NO: 211276 - RNA, 21 nt, Homo sapiens
uagcacccagauagcaaggau

SEQ ID NO: 211277 - RNA, 23 nt, Homo sapiens
ccuggcagcggaaacaauacccc

SEQ ID NO: 211278 - RNA, 23 nt, Homo sapiens
cugcagaacuguucccgcugcua

SEQ ID NO: 211279 - RNA, 22 nt, Homo sapiens
gauagagugcagaccagggucu

SEQ ID NO: 211280 - RNA, 22 nt, Homo sapiens
aggaaaccagcaaguguugacg

SEQ ID NO: 211281 - RNA, 22 nt, Homo sapiens
acaucaauacuuccuggcuccc

SEQ ID NO: 211282 - RNA, 21 nt, Homo sapiens
ucuacucagaagggugccuua

SEQ ID NO: 211283 - RNA, 22 nt, Homo sapiens
uuaaguaacaccuuccugaaua

SEQ ID NO: 211284 - RNA, 21 nt, Homo sapiens
uucacuccaaaaggugcaaaa

SEQ ID NO: 211285 - RNA, 23 nt, Homo sapiens
ucuacuccaaaaggcuacaauca

SEQ ID NO: 211286 - RNA, 23 nt, Homo sapiens
caugagugacgcccucuggagua

SEQ ID NO: 211287 - RNA, 22 nt, Homo sapiens
caugauugccacgucugcagua

SEQ ID NO: 211288 - RNA, 22 nt, Homo sapiens
cuacccacagacguaccaauca

SEQ ID NO: 211289 - RNA, 21 nt, Homo sapiens
ugauugccacugucugcagua

SEQ ID NO: 211290 - RNA, 22 nt, Homo sapiens
gugauugccacucuccugagua

SEQ ID NO: 211291 - RNA, 21 nt, Homo sapiens
ugacugcagagcaaaagacac

SEQ ID NO: 211292 - RNA, 22 nt, Homo sapiens
gaccucagcuaugacagcacuu

SEQ ID NO: 211293 - RNA, 23 nt, Homo sapiens
gaaagugcccucaaggcugagug

SEQ ID NO: 211294 - RNA, 23 nt, Homo sapiens
ccuucucagaaaggugaaauuua

SEQ ID NO: 211295 - RNA, 18 nt, Homo sapiens
augacaccucccugugaa

SEQ ID NO: 211296 - RNA, 22 nt, Homo sapiens
auaaaugacaccuccuugugaa

SEQ ID NO: 211297 - RNA, 23 nt, Homo sapiens
ucuucucagaaaggugaaauuua

SEQ ID NO: 211298 - RNA, 22 nt, Homo sapiens
auaaacgacaccuccuugagaa

SEQ ID NO: 211299 - RNA, 21 nt, Homo sapiens
ucuacucacagaagugucaau

SEQ ID NO: 211300 - RNA, 23 nt, Homo sapiens
caugauugucacucuccagagua

SEQ ID NO: 211301 - RNA, 21 nt, Homo sapiens
uccacucacagaggugucaau

SEQ ID NO: 211302 - RNA, 22 nt, Homo sapiens
augauugccucccucuugagaa

SEQ ID NO: 211303 - RNA, 22 nt, Homo sapiens
aacgcuccaaaagaaggcacuc

SEQ ID NO: 211304 - RNA, 24 nt, Homo sapiens
cagaaagugcuuucuuuuggagaa

SEQ ID NO: 211305 - RNA, 18 nt, Homo sapiens
acccucugaaaggaagca

SEQ ID NO: 211306 - RNA, 23 nt, Homo sapiens
gaaagugcuucuuuccucgagaa

SEQ ID NO: 211307 - RNA, 18 nt, Homo sapiens
acccucugaaaggaagca

SEQ ID NO: 211308 - RNA, 22 nt, Homo sapiens
aaagugcuucuuaccuccagau

SEQ ID NO: 211309 - RNA, 22 nt, Homo sapiens
agacagugcuuccaucuagagg

SEQ ID NO: 211310 - RNA, 22 nt, Homo sapiens
acacucuaaagggaugcacgau

SEQ ID NO: 211311 - RNA, 22 nt, Homo sapiens
acacucuaaagggaugcacgau

SEQ ID NO: 211312 - RNA, 22 nt, Homo sapiens
acacucuaaaaggaugcacgau

SEQ ID NO: 211313 - RNA, 22 nt, Homo sapiens
uccagcaaagggaagcgcuuuc

SEQ ID NO: 211314 - RNA, 20 nt, Homo sapiens
gaaagggcuucccuuugcag

SEQ ID NO: 211315 - RNA, 22 nt, Homo sapiens
accucuaaaggggagcgcuuug

SEQ ID NO: 211316 - RNA, 23 nt, Homo sapiens
acacucuaaagagaagcgcuuug

SEQ ID NO: 211317 - RNA, 23 nt, Homo sapiens
cagaaagugcuucccuccagaga

SEQ ID NO: 211318 - RNA, 21 nt, Homo sapiens
gcuccaaagggaagcgcuuug

SEQ ID NO: 211319 - RNA, 22 nt, Homo sapiens
cagaaagugcuucccucuagag

SEQ ID NO: 211320 - RNA, 21 nt, Homo sapiens
cacucugaagggaagcgcuuu

SEQ ID NO: 211321 - RNA, 22 nt, Homo sapiens
cagaaagcgcuucccucuagag

SEQ ID NO: 211322 - RNA, 21 nt, Homo sapiens
ccucuaaagagaagcgcuuuc

SEQ ID NO: 211323 - RNA, 22 nt, Homo sapiens
gagaaagugcuucccucuagag

SEQ ID NO: 211324 - RNA, 22 nt, Homo sapiens
acacucuaaaaggaugcacuuu

SEQ ID NO: 211325 - RNA, 22 nt, Homo sapiens
cagaaagcgcuucccucuagag

SEQ ID NO: 211326 - RNA, 22 nt, Homo sapiens
aaccucuaaaaggaugcacuuu

SEQ ID NO: 211327 - RNA, 22 nt, Homo sapiens
cagaaagcgcuucccucuagag

SEQ ID NO: 211328 - RNA, 22 nt, Homo sapiens
auccucuaaaaagaugcacuuu

SEQ ID NO: 211329 - RNA, 22 nt, Homo sapiens
cagaaagcgcuucccucuagag

SEQ ID NO: 211330 - RNA, 22 nt, Homo sapiens
cacucuaaagggaggcacuuug

SEQ ID NO: 211331 - RNA, 22 nt, Homo sapiens
aacacucuaaaaggaggcacuu

SEQ ID NO: 211332 - RNA, 22 nt, Homo sapiens
gaaagugcucccuuuuggagaa

SEQ ID NO: 211333 - RNA, 22 nt, Homo sapiens
acaguccaaagggaagcacuuu

SEQ ID NO: 211334 - RNA, 21 nt, Homo sapiens
agaaaguacuucccucuggag

SEQ ID NO: 211335 - RNA, 21 nt, Homo sapiens
cccucuaaaaggaagcacuuu

SEQ ID NO: 211336 - RNA, 22 nt, Homo sapiens
acccucuaaaaggaagcacuuu

SEQ ID NO: 211337 - RNA, 22 nt, Homo sapiens
cagaaagugcuucccucuagag

SEQ ID NO: 211338 - RNA, 22 nt, Homo sapiens
acccaccaaagagaagcacuuu

SEQ ID NO: 211339 - RNA, 20 nt, Homo sapiens
gaaagggcuucccuuuguag

SEQ ID NO: 211340 - RNA, 21 nt, Homo sapiens
cccucaaaaaggaagcacuuu

SEQ ID NO: 211341 - RNA, 22 nt, Homo sapiens
aacccucuaaaaggaagcacuu

SEQ ID NO: 211342 - RNA, 24 nt, Homo sapiens
acacucuaaagggaagcacuuugu

SEQ ID NO: 211343 - RNA, 22 nt, Homo sapiens
acucuaaagggaagcacuuugu

SEQ ID NO: 211344 - RNA, 22 nt, Homo sapiens
acacucuaaagggaagugcguu

SEQ ID NO: 211345 - RNA, 22 nt, Homo sapiens
acacucuaaagggaaccauuuu

SEQ ID NO: 211346 - RNA, 22 nt, Homo sapiens
cagaaagcgcuucccucuagag

SEQ ID NO: 211347 - RNA, 23 nt, Homo sapiens
acccucuauagggaagcgcguuc

SEQ ID NO: 211348 - RNA, 22 nt, Homo sapiens
cagaaagcgcuucccucuagag

SEQ ID NO: 211349 - RNA, 21 nt, Homo sapiens
acuccaaagggaagcgccuuc

SEQ ID NO: 211350 - RNA, 22 nt, Homo sapiens
gagaaagugcuucccuuuguag

SEQ ID NO: 211351 - RNA, 22 nt, Homo sapiens
cgcucuaaagggaagcgccuuc

SEQ ID NO: 211352 - RNA, 21 nt, Homo sapiens
agaaagugcaucccucuggag

SEQ ID NO: 211353 - RNA, 22 nt, Homo sapiens
cagaaagugcuucccucuagag

SEQ ID NO: 211354 - RNA, 22 nt, Homo sapiens
gccucuaaaaggaagcacuuuc

SEQ ID NO: 211355 - RNA, 23 nt, Homo sapiens
acagaaagugcuucccucaagag

SEQ ID NO: 211356 - RNA, 20 nt, Homo sapiens
gaaagggcuucccuuugcag

SEQ ID NO: 211357 - RNA, 22 nt, Homo sapiens
ugcaagccuugggugugggagg

SEQ ID NO: 211358 - RNA, 22 nt, Homo sapiens
acgguccuacacucaaggcaug

SEQ ID NO: 211359 - RNA, 22 nt, Homo sapiens
aaagaaauuguccuuguaugau

SEQ ID NO: 211360 - RNA, 22 nt, Homo sapiens
acacaccaaggauaauuucucc

SEQ ID NO: 211361 - RNA, 22 nt, Homo sapiens
aguccagauucugugcccacca

SEQ ID NO: 211362 - RNA, 25 nt, Homo sapiens
agugggaccgacagcagaauccuuu

SEQ ID NO: 211363 - RNA, 22 nt, Homo sapiens
uuucaguuaucaaucugucaca

SEQ ID NO: 211364 - RNA, 23 nt, Homo sapiens
ucucgugacaugaugauccccga

SEQ ID NO: 211365 - RNA, 22 nt, Homo sapiens
aagaagugcaccgcgaauguuu

SEQ ID NO: 211366 - RNA, 22 nt, Homo sapiens
gaacuugcuaaaaaugcagaau

SEQ ID NO: 211367 - RNA, 22 nt, Homo sapiens
uuagaaaugcacaaccucaggu

SEQ ID NO: 211368 - RNA, 22 nt, Homo sapiens
gcacacaauaaauguuugcuga

SEQ ID NO: 211369 - RNA, 22 nt, Homo sapiens
ucaucuaauaaacauuuacuga

SEQ ID NO: 211370 - RNA, 22 nt, Homo sapiens
uggugcaaaaguaacuguagcu

SEQ ID NO: 211371 - RNA, 20 nt, Homo sapiens
gaaaguaauugcaguuuuua

SEQ ID NO: 211372 - RNA, 23 nt, Homo sapiens
caaaaacugcaauuacuuuugca

SEQ ID NO: 211373 - RNA, 22 nt, Homo sapiens
uggcaaaaccgcaauuacuucu

SEQ ID NO: 211374 - RNA, 22 nt, Homo sapiens
gcaaaaguaauugccaguuuug

SEQ ID NO: 211375 - RNA, 22 nt, Homo sapiens
gguaaaacucgcaauuacuuuu

SEQ ID NO: 211376 - RNA, 25 nt, Homo sapiens
uggugcaaaaguaauugugguuuuu

SEQ ID NO: 211377 - RNA, 22 nt, Homo sapiens
agcaaaauccacaauuacuuuu

SEQ ID NO: 211378 - RNA, 22 nt, Homo sapiens
caaaaguaauugccgguuuuug

SEQ ID NO: 211379 - RNA, 22 nt, Homo sapiens
ugcaaaagucauugucguuuuc

SEQ ID NO: 211380 - RNA, 21 nt, Homo sapiens
ugaaaguaauugcaguuuuug

SEQ ID NO: 211381 - RNA, 21 nt, Homo sapiens
gcagaaaccacaauuaccuuu

SEQ ID NO: 211382 - RNA, 22 nt, Homo sapiens
gcaaaaguaacugcaguuuuug

SEQ ID NO: 211383 - RNA, 20 nt, Homo sapiens
caaacacugcaaucacuuuu

SEQ ID NO: 211384 - RNA, 22 nt, Homo sapiens
gggaaaaacugcaauuaccuuu

SEQ ID NO: 211385 - RNA, 21 nt, Homo sapiens
uaaaaguaauugcaguuuuua

SEQ ID NO: 211386 - RNA, 23 nt, Homo sapiens
caaaaacugcaauuacuuuugca

SEQ ID NO: 211387 - RNA, 21 nt, Homo sapiens
ucaaaaaccgcaguuacuuuu

SEQ ID NO: 211388 - RNA, 22 nt, Homo sapiens
ugguacaaaagucauugccguu

SEQ ID NO: 211389 - RNA, 22 nt, Homo sapiens
acaaaaguaacugcaguuuuug

SEQ ID NO: 211390 - RNA, 22 nt, Homo sapiens
ggcaaaaaccgcaauuacuuuu

SEQ ID NO: 211391 - RNA, 20 nt, Homo sapiens
caaaaaccacaaugccuuuu

SEQ ID NO: 211392 - RNA, 22 nt, Homo sapiens
ugcaaaaguagucacggucuuu

SEQ ID NO: 211393 - RNA, 22 nt, Homo sapiens
ugcaaaaaccguaguuacuucu

SEQ ID NO: 211394 - RNA, 19 nt, Homo sapiens
aaaaguaauugugguuuuu

SEQ ID NO: 211395 - RNA, 19 nt, Homo sapiens
aaagaccgcaauuacuuuu

SEQ ID NO: 211396 - RNA, 22 nt, Homo sapiens
gcaaaaguaauugcaguuuuug

SEQ ID NO: 211397 - RNA, 22 nt, Homo sapiens
ggcaaaaacagcaauuacuuuc

SEQ ID NO: 211398 - RNA, 21 nt, Homo sapiens
gcaaaaauaacugcaguuuua

SEQ ID NO: 211399 - RNA, 21 nt, Homo sapiens
gcaaaaacugcaauuacuuuu

SEQ ID NO: 211400 - RNA, 22 nt, Homo sapiens
acaaacauaauuguggguuuua

SEQ ID NO: 211401 - RNA, 22 nt, Homo sapiens
ggcaaaacccgcaauuacuuuu

SEQ ID NO: 211402 - RNA, 21 nt, Homo sapiens
acaaaaguuacugcgguuuug

SEQ ID NO: 211403 - RNA, 22 nt, Homo sapiens
agccaaaaccgcaauaacuuuu

SEQ ID NO: 211404 - RNA, 21 nt, Homo sapiens
cuggugcaaaaguaacugcca

SEQ ID NO: 211405 - RNA, 21 nt, Homo sapiens
gcaaaaaccgcaauuacuuuu

SEQ ID NO: 211406 - RNA, 20 nt, Homo sapiens
gcaaaaguaacugcaguuuu

SEQ ID NO: 211407 - RNA, 18 nt, Homo sapiens
aaauccgcaaguacuuuu

SEQ ID NO: 211408 - RNA, 20 nt, Homo sapiens
aaccgugaugacuuuugcac

SEQ ID NO: 211409 - RNA, 22 nt, Homo sapiens
ugcaagaguaaucgcgguuuug

SEQ ID NO: 211410 - RNA, 21 nt, Homo sapiens
gcaaaaaccacaauuacuuuu

SEQ ID NO: 211411 - RNA, 21 nt, Homo sapiens
gcaaaagugauugcaguuuuu

SEQ ID NO: 211412 - RNA, 22 nt, Homo sapiens
gcaaaaaccacaaucacuuuug

SEQ ID NO: 211413 - RNA, 22 nt, Homo sapiens
acaaaagcaacugagguucuug

SEQ ID NO: 211414 - RNA, 22 nt, Homo sapiens
ggccaaaaccacaauuacuuuu

SEQ ID NO: 211415 - RNA, 22 nt, Homo sapiens
gcaaaaguaauugagauuuuug

SEQ ID NO: 211416 - RNA, 22 nt, Homo sapiens
ggcaaaaaccgcaauuacuuuu

SEQ ID NO: 211417 - RNA, 22 nt, Homo sapiens
gcaaaagaaacugugguuuuug

SEQ ID NO: 211418 - RNA, 22 nt, Homo sapiens
ggcaaaaaccacaauuacuuuu

SEQ ID NO: 211419 - RNA, 22 nt, Homo sapiens
ugcaaaaguagucucaguuuuu

SEQ ID NO: 211420 - RNA, 19 nt, Homo sapiens
aaaaguaauuacaguuuuu

SEQ ID NO: 211421 - RNA, 22 nt, Homo sapiens
guacaaaaguaauuacaguuuu

SEQ ID NO: 211422 - RNA, 23 nt, Homo sapiens
caaaaacugcaauuacuuuugca

SEQ ID NO: 211423 - RNA, 23 nt, Homo sapiens
ugcaaaaguaauugcgguuuuug

SEQ ID NO: 211424 - RNA, 22 nt, Homo sapiens
gacaaaaaccgcgauuacuuuu

SEQ ID NO: 211425 - RNA, 22 nt, Homo sapiens
ggcaaaauccgcaauuacuuuu

SEQ ID NO: 211426 - RNA, 22 nt, Homo sapiens
accaaagaccgcaauuacuuuu

SEQ ID NO: 211427 - RNA, 22 nt, Homo sapiens
agcaaaauccgcaaguacuuuu

SEQ ID NO: 211428 - RNA, 22 nt, Homo sapiens
gacaaaacccgcaaauacuuuu

SEQ ID NO: 211429 - RNA, 21 nt, Homo sapiens
caaaaaccacaaauaccuuug

SEQ ID NO: 211430 - RNA, 22 nt, Homo sapiens
acaaaauccacaauuacuuuug

SEQ ID NO: 211431 - RNA, 22 nt, Homo sapiens
gcaaaaguaacugcaguuuugg

SEQ ID NO: 211432 - RNA, 22 nt, Homo sapiens
ggcaaaaaccgcaauuacuuuu

SEQ ID NO: 211433 - RNA, 22 nt, Homo sapiens
aaaguaacugcaguuuuugcua

SEQ ID NO: 211434 - RNA, 22 nt, Homo sapiens
ccgccauuacuuuugcaccagc

SEQ ID NO: 211435 - RNA, 23 nt, Homo sapiens
aaaauaacugcaguuuuggccau

SEQ ID NO: 211436 - RNA, 25 nt, Homo sapiens
uggugcaaaaguaauugugguuuuu

SEQ ID NO: 211437 - RNA, 21 nt, Homo sapiens
caaaaaccacgaucacuuuug

SEQ ID NO: 211438 - RNA, 23 nt, Homo sapiens
cgcaaaaguaauugcagucuuug

SEQ ID NO: 211439 - RNA, 23 nt, Homo sapiens
aggcaaaaaccgcaguuacuuuu

SEQ ID NO: 211440 - RNA, 22 nt, Homo sapiens
ggcaaaaacagugauuacuuuu

SEQ ID NO: 211441 - RNA, 23 nt, Homo sapiens
ugcaaaaguaauugcgguuuuug

SEQ ID NO: 211442 - RNA, 21 nt, Homo sapiens
agagcucauccauaguuguca

SEQ ID NO: 211443 - RNA, 20 nt, Homo sapiens
cucuuacucccucaggcacu

SEQ ID NO: 211444 - RNA, 22 nt, Homo sapiens
augugccugagggaguaagaca

SEQ ID NO: 211445 - RNA, 23 nt, Homo sapiens
gggcucuuacucccucaggcacu

SEQ ID NO: 211446 - RNA, 22 nt, Homo sapiens
ugucuuacucccucaggcacau

SEQ ID NO: 211447 - RNA, 20 nt, Homo sapiens
cagugccugagggaguaaga

SEQ ID NO: 211448 - RNA, 21 nt, Homo sapiens
uggaaaccaagagugggucgc

SEQ ID NO: 211449 - RNA, 21 nt, Homo sapiens
cugaaaccaaguaugggucgc

SEQ ID NO: 211450 - RNA, 22 nt, Homo sapiens
ggucucacccacgcuugauuuc

SEQ ID NO: 211451 - RNA, 21 nt, Homo sapiens
uugucuaaccagucaccuguu

SEQ ID NO: 211452 - RNA, 21 nt, Homo sapiens
aaaacaaaaucucaccguuuu

SEQ ID NO: 211453 - RNA, 21 nt, Homo sapiens
acuggcugagucaggacuagc

SEQ ID NO: 211454 - RNA, 21 nt, Homo sapiens
aucagagguucagcuuacccu

SEQ ID NO: 211455 - RNA, 22 nt, Homo sapiens
aaagaugagcuaaugguaauau

SEQ ID NO: 211456 - RNA, 22 nt, Homo sapiens
cucauauuacaaugagcucauc

SEQ ID NO: 211457 - RNA, 23 nt, Homo sapiens
agacaaggcccacccgugcaaac

SEQ ID NO: 211458 - RNA, 19 nt, Homo sapiens
auuuugguacagcagcuca

SEQ ID NO: 211459 - RNA, 21 nt, Homo sapiens
uuuuggugcauauuuacuuua

SEQ ID NO: 211460 - RNA, 22 nt, Homo sapiens
acuucaaggaucuuaaacuuug

SEQ ID NO: 211461 - RNA, 22 nt, Homo sapiens
ggcaaaguuuaagauccuugau

SEQ ID NO: 211462 - RNA, 20 nt, Homo sapiens
gcaaaugguacagcuacuuu

SEQ ID NO: 211463 - RNA, 19 nt, Homo sapiens
gggaaacguaugucaaccu

SEQ ID NO: 211464 - RNA, 19 nt, Homo sapiens
gccugcugacaccgugccu

SEQ ID NO: 211465 - RNA, 19 nt, Homo sapiens
guugggaucacaggcgccc

SEQ ID NO: 211466 - RNA, 23 nt, Homo sapiens
guucuguccuggaagaacauacu

SEQ ID NO: 211467 - RNA, 20 nt, Homo sapiens
guguguauacauuuauacau

SEQ ID NO: 211468 - RNA, 21 nt, Homo sapiens
acuuuccaggauucauuaacu

SEQ ID NO: 211469 - RNA, 22 nt, Homo sapiens
gcaaagguaauugcuguuuucg

SEQ ID NO: 211470 - RNA, 22 nt, Homo sapiens
gggaaaaacugcaauuaccuuu

SEQ ID NO: 211471 - RNA, 21 nt, Homo sapiens
cucacucagauggccaacuca

SEQ ID NO: 211472 - RNA, 20 nt, Homo sapiens
ugggccaccgccgagcggac

SEQ ID NO: 211473 - RNA, 24 nt, Homo sapiens
cugaucaguuacacaucacuucag

SEQ ID NO: 211474 - RNA, 22 nt, Homo sapiens
ugugggugugugcaugagcgug

SEQ ID NO: 211475 - RNA, 23 nt, Homo sapiens
acacacucacacacacacacuca

SEQ ID NO: 211476 - RNA, 19 nt, Homo sapiens
gcuccuguccaacuggcuc

SEQ ID NO: 211477 - RNA, 22 nt, Homo sapiens
gauuccaauuuuuccacaucuu

SEQ ID NO: 211478 - RNA, 22 nt, Homo sapiens
aaagacguggagaaauuagaau

SEQ ID NO: 211479 - RNA, 21 nt, Homo sapiens
cagguaccaauauuuuaucua

SEQ ID NO: 211480 - RNA, 21 nt, Homo sapiens
acaauccuagagcacaagaag

SEQ ID NO: 211481 - RNA, 23 nt, Homo sapiens
aaucgcgguuuauaccaaaugaa

SEQ ID NO: 211482 - RNA, 22 nt, Homo sapiens
ccuaaugauucaucauucucaa

SEQ ID NO: 211483 - RNA, 21 nt, Homo sapiens
acugaucuagagaacacaaga

SEQ ID NO: 211484 - RNA, 22 nt, Homo sapiens
gguucaguuguucaaccaguua

SEQ ID NO: 211485 - RNA, 23 nt, Homo sapiens
aguaacugguugaacaacuguaa

SEQ ID NO: 211486 - RNA, 21 nt, Homo sapiens
guaaugggaccuuccucuuug

SEQ ID NO: 211487 - RNA, 22 nt, Homo sapiens
agccugguuggccuggaacuga

SEQ ID NO: 211488 - RNA, 22 nt, Homo sapiens
cucagucccaggcaaaccauaa

SEQ ID NO: 211489 - RNA, 19 nt, Homo sapiens
uagcauacagauacgccca

SEQ ID NO: 211490 - RNA, 22 nt, Homo sapiens
ggaccuaaaaauacaaugcaua

SEQ ID NO: 211491 - RNA, 21 nt, Homo sapiens
gugacucaucaccuauggaaa

SEQ ID NO: 211492 - RNA, 21 nt, Homo sapiens
guucuaacccauuguggccaa

SEQ ID NO: 211493 - RNA, 24 nt, Homo sapiens
ucugggaaccggcauuuguucuga

SEQ ID NO: 211494 - RNA, 22 nt, Homo sapiens
cucagagcagacgugguucuca

SEQ ID NO: 211495 - RNA, 21 nt, Homo sapiens
acuagcuuauacauaaaauua

SEQ ID NO: 211496 - RNA, 22 nt, Homo sapiens
cugcacuuuuaugaauaagcuc

SEQ ID NO: 211497 - RNA, 20 nt, Homo sapiens
acaaugagaacccauggucu

SEQ ID NO: 211498 - RNA, 22 nt, Homo sapiens
acaucaucgcauauugacacaa

SEQ ID NO: 211499 - RNA, 19 nt, Homo sapiens
agaaaccccagcagagaca

SEQ ID NO: 211500 - RNA, 25 nt, Homo sapiens
gcugagcaaugccuggcuggugccu

SEQ ID NO: 211501 - RNA, 21 nt, Homo sapiens
agacacaccacggcacacuuc

SEQ ID NO: 211502 - RNA, 21 nt, Homo sapiens
cccgaggagccgggcaggcuu

SEQ ID NO: 211503 - RNA, 22 nt, Homo sapiens
acaguggucaucgagugacaca

SEQ ID NO: 211504 - RNA, 22 nt, Homo sapiens
ugacgaugacaacgaugacgua

SEQ ID NO: 211505 - RNA, 20 nt, Homo sapiens
guuugauaaacugacacaac

SEQ ID NO: 211506 - RNA, 23 nt, Homo sapiens
gagcaaggcucuugucuguaagu

SEQ ID NO: 211507 - RNA, 22 nt, Homo sapiens
cuccuccaacaauccuagacca

SEQ ID NO: 211508 - RNA, 23 nt, Homo sapiens
gggccgcagcugucgcccguguc

SEQ ID NO: 211509 - RNA, 22 nt, Homo sapiens
gcaaaaguaauugcagugugug

SEQ ID NO: 211510 - RNA, 19 nt, Homo sapiens
guccugaauuccgcagccu

SEQ ID NO: 211511 - RNA, 23 nt, Homo sapiens
aggagaaggcaccaugggauuua

SEQ ID NO: 211512 - RNA, 21 nt, Homo sapiens
aucuuugauuuucaguaguuu

SEQ ID NO: 211513 - RNA, 21 nt, Homo sapiens
guuauagaucuggauuugaac

SEQ ID NO: 211514 - RNA, 25 nt, Homo sapiens
acggagcugucccaacaccaccccu

SEQ ID NO: 211515 - RNA, 20 nt, Homo sapiens
agagaugagagaaacacccu

SEQ ID NO: 211516 - RNA, 21 nt, Homo sapiens
ucccagcacacauuuagcuca

SEQ ID NO: 211517 - RNA, 23 nt, Homo sapiens
gucagaccccgagggguccucgc

SEQ ID NO: 211518 - RNA, 25 nt, Homo sapiens
aaggagcucagaagcccugcccagc

SEQ ID NO: 211519 - RNA, 20 nt, Homo sapiens
ggcaaagaaggaacauuccu

SEQ ID NO: 211520 - RNA, 23 nt, Homo sapiens
ccaccuggcaagaacaggcguuc

SEQ ID NO: 211521 - RNA, 22 nt, Homo sapiens
aagagggagacccaggcucgga

SEQ ID NO: 211522 - RNA, 22 nt, Homo sapiens
gauccgagcaccggggaccccc

SEQ ID NO: 211523 - RNA, 22 nt, Homo sapiens
cugcucaaacccuccaaugacu

SEQ ID NO: 211524 - RNA, 22 nt, Homo sapiens
aagucacugaaggguuuugagu

SEQ ID NO: 211525 - RNA, 22 nt, Homo sapiens
gccaccuucaaaugggaagucu

SEQ ID NO: 211526 - RNA, 23 nt, Homo sapiens
acucagaaggacaaguagaguuu

SEQ ID NO: 211527 - RNA, 24 nt, Homo sapiens
acugggcacaaacauguccagguc

SEQ ID NO: 211528 - RNA, 20 nt, Homo sapiens
auuucuauaucuaucuccau

SEQ ID NO: 211529 - RNA, 21 nt, Homo sapiens
agguaagcgcuguugcuagcc

SEQ ID NO: 211530 - RNA, 21 nt, Homo sapiens
gcuccaaccucagcagacugu

SEQ ID NO: 211531 - RNA, 23 nt, Homo sapiens
acccaacagccccugcaagggau

SEQ ID NO: 211532 - RNA, 21 nt, Homo sapiens
agguaauaccaauaccuugug

SEQ ID NO: 211533 - RNA, 22 nt, Homo sapiens
ugaacacaagguacugguacua

SEQ ID NO: 211534 - RNA, 22 nt, Homo sapiens
ugagggggaaaguucuauaguc

SEQ ID NO: 211535 - RNA, 21 nt, Homo sapiens
ggacuauagaacuuucccccu

SEQ ID NO: 211536 - RNA, 19 nt, Homo sapiens
aagacauuuucagacagcu

SEQ ID NO: 211537 - RNA, 22 nt, Homo sapiens
uccucuuuucuuagagacucac

SEQ ID NO: 211538 - RNA, 21 nt, Homo sapiens
ucgacugccacucuuacuaga

SEQ ID NO: 211539 - RNA, 22 nt, Homo sapiens
ccucuaguaaauaugucagcau

SEQ ID NO: 211540 - RNA, 22 nt, Homo sapiens
gcugggcuuacguugggagaac

SEQ ID NO: 211541 - RNA, 21 nt, Homo sapiens
aguucucccaacguaaaccca

SEQ ID NO: 211542 - RNA, 22 nt, Homo sapiens
accuucccugguacagaauacu

SEQ ID NO: 211543 - RNA, 21 nt, Homo sapiens
gcugaggucugggccaggucu

SEQ ID NO: 211544 - RNA, 19 nt, Homo sapiens
ucccacaggaagcagacac

SEQ ID NO: 211545 - RNA, 23 nt, Homo sapiens
uuuauugugguagauacuauuag

SEQ ID NO: 211546 - RNA, 22 nt, Homo sapiens
guccaaaguuggggugcugguu

SEQ ID NO: 211547 - RNA, 23 nt, Homo sapiens
ggacauuguuucagugcccaagu

SEQ ID NO: 211548 - RNA, 23 nt, Homo sapiens
ugcgggcgggacgagcaagcaca

SEQ ID NO: 211549 - RNA, 24 nt, Homo sapiens
acgcagagcccgaaagcccccagu

SEQ ID NO: 211550 - RNA, 25 nt, Homo sapiens
aggccgccacccgcccgcgaucccu

SEQ ID NO: 211551 - RNA, 23 nt, Homo sapiens
acagcgcucgcaaccgcagcgau

SEQ ID NO: 211552 - RNA, 21 nt, Homo sapiens
agaggcagguuccuggaucau

SEQ ID NO: 211553 - RNA, 24 nt, Homo sapiens
gaggugacucuauccuaugucuuu

SEQ ID NO: 211554 - RNA, 22 nt, Homo sapiens
gguucccucuccaaaugugucu

SEQ ID NO: 211555 - RNA, 22 nt, Homo sapiens
caagacacauuuggagagggac

SEQ ID NO: 211556 - RNA, 22 nt, Homo sapiens
gggucccucuccaaaugugucu

SEQ ID NO: 211557 - RNA, 22 nt, Homo sapiens
agacacauuuggagagggaacc

SEQ ID NO: 211558 - RNA, 22 nt, Homo sapiens
cuaccugagcuagcauacaagu

SEQ ID NO: 211559 - RNA, 19 nt, Homo sapiens
gcucuaagaaagccacacu

SEQ ID NO: 211560 - RNA, 19 nt, Homo sapiens
ucagcaguaccagccuaga

SEQ ID NO: 211561 - RNA, 19 nt, Homo sapiens
gccucagaggcagcugcuu

SEQ ID NO: 211562 - RNA, 21 nt, Homo sapiens
gaaggaagugagugcagccac

SEQ ID NO: 211563 - RNA, 19 nt, Homo sapiens
accagugcccugcacacuu

SEQ ID NO: 211564 - RNA, 22 nt, Homo sapiens
gacucuugaacaacacagguuu

SEQ ID NO: 211565 - RNA, 21 nt, Homo sapiens
guccugagagcgcugccuccu

SEQ ID NO: 211566 - RNA, 22 nt, Homo sapiens
caaaagucaagcuuauccuaaa

SEQ ID NO: 211567 - RNA, 21 nt, Homo sapiens
cacaacccuaguggcgccauu

SEQ ID NO: 211568 - RNA, 25 nt, Homo sapiens
ugaauggcacccucuccuaggguug

SEQ ID NO: 211569 - RNA, 21 nt, Homo sapiens
caguagagauuguuucaacac

SEQ ID NO: 211570 - RNA, 22 nt, Homo sapiens
aaggugauggucagcagacaua

SEQ ID NO: 211571 - RNA, 22 nt, Homo sapiens
gcacauguucugcggcccacca

SEQ ID NO: 211572 - RNA, 22 nt, Homo sapiens
aaagagguuaaccauguauuau

SEQ ID NO: 211573 - RNA, 21 nt, Homo sapiens
agagguugacuguauaauauu

SEQ ID NO: 211574 - RNA, 23 nt, Homo sapiens
ccuagagagggugagaaccugcc

SEQ ID NO: 211575 - RNA, 25 nt, Homo sapiens
accaacggaccuacuucccuccgcc

SEQ ID NO: 211576 - RNA, 22 nt, Homo sapiens
uggggacccucccugaaccaag

SEQ ID NO: 211577 - RNA, 22 nt, Homo sapiens
uccuugguucagggaagguccu

SEQ ID NO: 211578 - RNA, 21 nt, Homo sapiens
uaauccaugcacacaggaggu

SEQ ID NO: 211579 - RNA, 22 nt, Homo sapiens
caacuccgauaugcaaugggua

SEQ ID NO: 211580 - RNA, 24 nt, Homo sapiens
acgcgcaggccagagacccaggca

SEQ ID NO: 211581 - RNA, 21 nt, Homo sapiens
cugcugggccacaacguggga

SEQ ID NO: 211582 - RNA, 22 nt, Homo sapiens
gcggucccgcggcgccccgccu

SEQ ID NO: 211583 - RNA, 22 nt, Homo sapiens
ccucaggcacggccgggccacc

SEQ ID NO: 211584 - RNA, 23 nt, Homo sapiens
uguaggcuggggauaaaugaaua

SEQ ID NO: 211585 - RNA, 24 nt, Homo sapiens
auccaaucauuuucccuagccagu

SEQ ID NO: 211586 - RNA, 22 nt, Homo sapiens
uguaggcugggaggcaaaugaa

SEQ ID NO: 211587 - RNA, 24 nt, Homo sapiens
uacccaaucaucucccuuagccca

SEQ ID NO: 211588 - RNA, 20 nt, Homo sapiens
aggggccucagccuccuggu

SEQ ID NO: 211589 - RNA, 23 nt, Homo sapiens
guagugggccgagccgagugaca

SEQ ID NO: 211590 - RNA, 20 nt, Homo sapiens
caccacauacacucagggac

SEQ ID NO: 211591 - RNA, 21 nt, Homo sapiens
gguggagcccugagaaccgga

SEQ ID NO: 211592 - RNA, 23 nt, Homo sapiens
cuccagccccuccagggcuuccu

SEQ ID NO: 211593 - RNA, 20 nt, Homo sapiens
ugagcggugagggcauacag

SEQ ID NO: 211594 - RNA, 23 nt, Homo sapiens
cacugugggcccucuccgcacca

SEQ ID NO: 211595 - RNA, 21 nt, Homo sapiens
aacucaacaaccuuaggacag

SEQ ID NO: 211596 - RNA, 21 nt, Homo sapiens
ugcaaguccugagguugaaga

SEQ ID NO: 211597 - RNA, 22 nt, Homo sapiens
cuagaagcucacagucuaguug

SEQ ID NO: 211598 - RNA, 23 nt, Homo sapiens
cccagcuagauuguaagcuccuu

SEQ ID NO: 211599 - RNA, 22 nt, Homo sapiens
cuuacgucucucccuggguccc

SEQ ID NO: 211600 - RNA, 21 nt, Homo sapiens
cgacgcccggcggggcggaag

SEQ ID NO: 211601 - RNA, 22 nt, Homo sapiens
agguugagguuaguggcaacag

SEQ ID NO: 211602 - RNA, 22 nt, Homo sapiens
ugcuguuagcccuagccccgca

SEQ ID NO: 211603 - RNA, 22 nt, Homo sapiens
gguuaguggaccaggucacaaa

SEQ ID NO: 211604 - RNA, 22 nt, Homo sapiens
gugugcucucuggucaaccauc

SEQ ID NO: 211605 - RNA, 22 nt, Homo sapiens
gucaaaauuguuugcacucugc

SEQ ID NO: 211606 - RNA, 20 nt, Homo sapiens
uccccacagacccagagccg

SEQ ID NO: 211607 - RNA, 22 nt, Homo sapiens
ugugucaguuucacccugcugc

SEQ ID NO: 211608 - RNA, 22 nt, Homo sapiens
gcucggccccggccccagcccc

SEQ ID NO: 211609 - RNA, 22 nt, Homo sapiens
aggaggacaagugagcaccugc

SEQ ID NO: 211610 - RNA, 21 nt, Homo sapiens
caucaccuuccuucuccucca

SEQ ID NO: 211611 - RNA, 22 nt, Homo sapiens
gcugaggcuguggggcuggagu

SEQ ID NO: 211612 - RNA, 22 nt, Homo sapiens
aagaccagcaccaauuccuccu

SEQ ID NO: 211613 - RNA, 23 nt, Homo sapiens
agaaaccaugggguaugagcaga

SEQ ID NO: 211614 - RNA, 23 nt, Homo sapiens
caugcucagacaaccauggugca

SEQ ID NO: 211615 - RNA, 23 nt, Homo sapiens
aaccaagaccccggagaucccag

SEQ ID NO: 211616 - RNA, 22 nt, Homo sapiens
agcucagaacccagaggucuca

SEQ ID NO: 211617 - RNA, 23 nt, Homo sapiens
uggcccugacacgugguacugga

SEQ ID NO: 211618 - RNA, 23 nt, Homo sapiens
acaaggaugaaucuuuguuacug

SEQ ID NO: 211619 - RNA, 22 nt, Homo sapiens
ucccgggaacucaucagucucc

SEQ ID NO: 211620 - RNA, 21 nt, Homo sapiens
aggagacucacaaguuccugc

SEQ ID NO: 211621 - RNA, 22 nt, Homo sapiens
ucggucccucgggccagggcag

SEQ ID NO: 211622 - RNA, 21 nt, Homo sapiens
cacaaccucaguguuuccagg

SEQ ID NO: 211623 - RNA, 22 nt, Homo sapiens
caccugauaaaacugagguaua

SEQ ID NO: 211624 - RNA, 22 nt, Homo sapiens
ugaauuacuuuguaaaccacca

SEQ ID NO: 211625 - RNA, 22 nt, Homo sapiens
uggugauucacaaagaaaucca

SEQ ID NO: 211626 - RNA, 21 nt, Homo sapiens
cugggaggagggagaagagga

SEQ ID NO: 211627 - RNA, 20 nt, Homo sapiens
cccugcgccaucuccucuac

SEQ ID NO: 211628 - RNA, 22 nt, Homo sapiens
uauccacuacaccccgcugccu

SEQ ID NO: 211629 - RNA, 22 nt, Homo sapiens
agaggcaggguaguguaaugga

SEQ ID NO: 211630 - RNA, 22 nt, Homo sapiens
ccucgggauggcgcccguucac

SEQ ID NO: 211631 - RNA, 22 nt, Homo sapiens
uucacccaaagaggugucaguc

SEQ ID NO: 211632 - RNA, 21 nt, Homo sapiens
ugacugacagcuuuuugagua

SEQ ID NO: 211633 - RNA, 21 nt, Homo sapiens
acaaugguuguccgauauuaa

SEQ ID NO: 211634 - RNA, 21 nt, Homo sapiens
caacugaugccuuuccaagua

SEQ ID NO: 211635 - RNA, 22 nt, Homo sapiens
ucaguggcucagguucguugca

SEQ ID NO: 211636 - RNA, 22 nt, Homo sapiens
ucaaugacucagguaaguugca

SEQ ID NO: 211637 - RNA, 21 nt, Homo sapiens
cuacgcagaaaggacacagug

SEQ ID NO: 211638 - RNA, 22 nt, Homo sapiens
ucuacccagaaaggagccagug

SEQ ID NO: 211639 - RNA, 22 nt, Homo sapiens
uccacucagaaaggaaacagug

SEQ ID NO: 211640 - RNA, 21 nt, Homo sapiens
ugacuggcaccuuucugaaua

SEQ ID NO: 211641 - RNA, 20 nt, Homo sapiens
uacugcuuccacagcucccc

SEQ ID NO: 211642 - RNA, 25 nt, Homo sapiens
gaauccugguucugucccucacuag

SEQ ID NO: 211643 - RNA, 23 nt, Homo sapiens
gacguaguccuauucucugcugc

SEQ ID NO: 211644 - RNA, 20 nt, Homo sapiens
gcaagacaucacaagacucu

SEQ ID NO: 211645 - RNA, 22 nt, Homo sapiens
gggagaggucucccugcgcaca

SEQ ID NO: 211646 - RNA, 22 nt, Homo sapiens
ccagugucuccaguaguagaca

SEQ ID NO: 211647 - RNA, 23 nt, Homo sapiens
gcgguagcggaagcgguaacugg

SEQ ID NO: 211648 - RNA, 22 nt, Homo sapiens
cugcgauuccucccucuacugu

SEQ ID NO: 211649 - RNA, 22 nt, Homo sapiens
ggcagagagucagagcgcggau

SEQ ID NO: 211650 - RNA, 20 nt, Homo sapiens
ccagccccacccugacucac

SEQ ID NO: 211651 - RNA, 22 nt, Homo sapiens
acuggguucaccuuuaagggca

SEQ ID NO: 211652 - RNA, 21 nt, Homo sapiens
cuggggagcagaggcccaggg

SEQ ID NO: 211653 - RNA, 24 nt, Homo sapiens
cacccccagagccucagcucccca

SEQ ID NO: 211654 - RNA, 21 nt, Homo sapiens
ggggagcgggggcccugccuu

SEQ ID NO: 211655 - RNA, 23 nt, Homo sapiens
gcacaugugcacacagccgggug

SEQ ID NO: 211656 - RNA, 22 nt, Homo sapiens
cacauggccaaaacagagaaga

SEQ ID NO: 211657 - RNA, 21 nt, Homo sapiens
cuggaggacggcaacagucag

SEQ ID NO: 211658 - RNA, 22 nt, Homo sapiens
cucauccgauguacaauaauuu

SEQ ID NO: 211659 - RNA, 21 nt, Homo sapiens
cuagggaagaacagugagcaa

SEQ ID NO: 211660 - RNA, 18 nt, Homo sapiens
caugcucagcugacccug

SEQ ID NO: 211661 - RNA, 21 nt, Homo sapiens
ccaaccaaugaaagaaugcuu

SEQ ID NO: 211662 - RNA, 22 nt, Homo sapiens
acacacccacgcgagccggaaa

SEQ ID NO: 211663 - RNA, 21 nt, Homo sapiens
cggcucggguggcggcgacgg

SEQ ID NO: 211664 - RNA, 23 nt, Homo sapiens
gucacaucccucccaagacccuc

SEQ ID NO: 211665 - RNA, 27 nt, Homo sapiens
ugcccacucucaccaucaccuacagug

SEQ ID NO: 211666 - RNA, 23 nt, Homo sapiens
ggaagccaucaagucgcugcagg

SEQ ID NO: 211667 - RNA, 22 nt, Homo sapiens
auaagagucucccccuguauau

SEQ ID NO: 211668 - RNA, 22 nt, Homo sapiens
augagagucucccccuguauau

SEQ ID NO: 211669 - RNA, 21 nt, Homo sapiens
aacauacaaaggguauccucu

SEQ ID NO: 211670 - RNA, 23 nt, Homo sapiens
gcacgucaccggucuaccauccc

SEQ ID NO: 211671 - RNA, 21 nt, Homo sapiens
agaaguagaccauguguccua

SEQ ID NO: 211672 - RNA, 22 nt, Homo sapiens
gaggcucagaauggcucaggag

SEQ ID NO: 211673 - RNA, 21 nt, Homo sapiens
cucccccacugcagcuggcac

SEQ ID NO: 211674 - RNA, 21 nt, Homo sapiens
gagcugcauccuggcuccggg

SEQ ID NO: 211675 - RNA, 21 nt, Homo sapiens
auaauggagaccaggccacga

SEQ ID NO: 211676 - RNA, 20 nt, Homo sapiens
cucaaagcaaacccugcaga

SEQ ID NO: 211677 - RNA, 21 nt, Homo sapiens
gcuuaaacaucuacaugaaca

SEQ ID NO: 211678 - RNA, 18 nt, Homo sapiens
gaaaugagggccagcuga

SEQ ID NO: 211679 - RNA, 21 nt, Homo sapiens
ccccucccagccucccugcca

SEQ ID NO: 211680 - RNA, 20 nt, Homo sapiens
uccgccugucugaacaguga

SEQ ID NO: 211681 - RNA, 21 nt, Homo sapiens
cugaggagagaggaggugggg

SEQ ID NO: 211682 - RNA, 19 nt, Homo sapiens
ccaccucccgaguccucac

SEQ ID NO: 211683 - RNA, 22 nt, Homo sapiens
cugggggcggcacaggggcuca

SEQ ID NO: 211684 - RNA, 22 nt, Homo sapiens
ccccccacugggccguacccac

SEQ ID NO: 211685 - RNA, 22 nt, Homo sapiens
cuagggaacacagggcugguga

SEQ ID NO: 211686 - RNA, 26 nt, Homo sapiens
ccccauccaggccugcaugcccucac

SEQ ID NO: 211687 - RNA, 20 nt, Homo sapiens
cuggggaaaaggguggcacg

SEQ ID NO: 211688 - RNA, 17 nt, Homo sapiens
ccaccgccuggccccac

SEQ ID NO: 211689 - RNA, 20 nt, Homo sapiens
ggggggcgaggcagguguga

SEQ ID NO: 211690 - RNA, 21 nt, Homo sapiens
cacacaccugcccccgcccac

SEQ ID NO: 211691 - RNA, 23 nt, Homo sapiens
cugugggagggcaguggugagag

SEQ ID NO: 211692 - RNA, 24 nt, Homo sapiens
cgcucucccccaaacccuacccac

SEQ ID NO: 211693 - RNA, 20 nt, Homo sapiens
gcagcuguccgcccagacac

SEQ ID NO: 211694 - RNA, 22 nt, Homo sapiens
ugccgugcccuggccucccacu

SEQ ID NO: 211695 - RNA, 20 nt, Homo sapiens
cugcgggaggacagggcuca

SEQ ID NO: 211696 - RNA, 22 nt, Homo sapiens
gugggguggguggucaggccga

SEQ ID NO: 211697 - RNA, 21 nt, Homo sapiens
cggcccccccccccccccccc

SEQ ID NO: 211698 - RNA, 22 nt, Homo sapiens
cuggagagacaaggggaagagg

SEQ ID NO: 211699 - RNA, 22 nt, Homo sapiens
uccccauuuccccugucacuca

SEQ ID NO: 211700 - RNA, 21 nt, Homo sapiens
cugggggacggagcagaagga

SEQ ID NO: 211701 - RNA, 21 nt, Homo sapiens
cgcgcuucggccccgcccccg

SEQ ID NO: 211702 - RNA, 20 nt, Homo sapiens
ggggcagacagacgaggaag

SEQ ID NO: 211703 - RNA, 23 nt, Homo sapiens
cacacacuggggcucccacucac

SEQ ID NO: 211704 - RNA, 22 nt, Homo sapiens
cacuccuauaauugauccaguu

SEQ ID NO: 211705 - RNA, 26 nt, Homo sapiens
aaccaucucauacaaaccaacuacuu

SEQ ID NO: 211706 - RNA, 21 nt, Homo sapiens
auguaggccuuuagaucacuu

SEQ ID NO: 211707 - RNA, 22 nt, Homo sapiens
uauaggccuuuagaucaucuga

SEQ ID NO: 211708 - RNA, 21 nt, Homo sapiens
uuuaagugaucuaaaggccua

SEQ ID NO: 211709 - RNA, 19 nt, Homo sapiens
ccugcuccaaaaauccauu

SEQ ID NO: 211710 - RNA, 24 nt, Homo sapiens
gcuccagucucgacguucccgggg

SEQ ID NO: 211711 - RNA, 22 nt, Homo sapiens
uccggggacgaacgggacgggu

SEQ ID NO: 211712 - RNA, 27 nt, Homo sapiens
uuuagcacagugcuuauacaagaaggu

SEQ ID NO: 211713 - RNA, 22 nt, Homo sapiens
ugaagaagggggggaagggcgu

SEQ ID NO: 211714 - RNA, 21 nt, Homo sapiens
aaaggccacauccagcaccgu

SEQ ID NO: 211715 - RNA, 21 nt, Homo sapiens
agcgccuuuggcagcuagagu

SEQ ID NO: 211716 - RNA, 22 nt, Homo sapiens
uaaaugaauucaauuuccuucu

SEQ ID NO: 211717 - RNA, 21 nt, Homo sapiens
ugcaggcugaucuucuucucu

SEQ ID NO: 211718 - RNA, 24 nt, Homo sapiens
acugcaggcuccagcuuccaggcu

SEQ ID NO: 211719 - RNA, 23 nt, Homo sapiens
aaucuacuuucuuugcucauccu

SEQ ID NO: 211720 - RNA, 22 nt, Homo sapiens
uggaugagcaaagaaagugguu

SEQ ID NO: 211721 - RNA, 22 nt, Homo sapiens
aaccacuuucuuugcucauccg

SEQ ID NO: 211722 - RNA, 22 nt, Homo sapiens
agcuagugagaagucaaugccu

SEQ ID NO: 211723 - RNA, 21 nt, Homo sapiens
ggucagaacccaucauucacu

SEQ ID NO: 211724 - RNA, 21 nt, Homo sapiens
uuccacgaccuaauccuaacu

SEQ ID NO: 211725 - RNA, 18 nt, Homo sapiens
ugguggcagaggugggau

SEQ ID NO: 211726 - RNA, 19 nt, Homo sapiens
augguggcaguggugggau

SEQ ID NO: 211727 - RNA, 19 nt, Homo sapiens
aagccaaagccuuauccau

SEQ ID NO: 211728 - RNA, 22 nt, Homo sapiens
auccuucuacaaauucacccau

SEQ ID NO: 211729 - RNA, 22 nt, Homo sapiens
acucaguaugccaggguaccau

SEQ ID NO: 211730 - RNA, 23 nt, Homo sapiens
aacaggugcucaaauaagacuug

SEQ ID NO: 211731 - RNA, 22 nt, Homo sapiens
aacaacacuugaccacauccug

SEQ ID NO: 211732 - RNA, 23 nt, Homo sapiens
agcccuguucuacagcccugagg

SEQ ID NO: 211733 - RNA, 21 nt, Homo sapiens
uggggauuacacuucaacagg

SEQ ID NO: 211734 - RNA, 18 nt, Homo sapiens
cccccaccaccacgcccg

SEQ ID NO: 211735 - RNA, 20 nt, Homo sapiens
cacccccaccaccacgcccg

SEQ ID NO: 211736 - RNA, 22 nt, Homo sapiens
ccaguagcacggcucaguccag

SEQ ID NO: 211737 - RNA, 22 nt, Homo sapiens
ccaguagcauggcucaguccag

SEQ ID NO: 211738 - RNA, 23 nt, Homo sapiens
acacagcucuuccauaucuccag

SEQ ID NO: 211739 - RNA, 22 nt, Homo sapiens
ugccuggcacauagcaggcacu

SEQ ID NO: 211740 - RNA, 22 nt, Homo sapiens
ugagugcuugcuaggugccaag

SEQ ID NO: 211741 - RNA, 26 nt, Homo sapiens
uuucagaauuugcugccaucaucauc

SEQ ID NO: 211742 - RNA, 25 nt, Homo sapiens
aagaaagagucuugcuuugucgccc

SEQ ID NO: 211743 - RNA, 22 nt, Homo sapiens
gacagggucucguuuugucgcc

SEQ ID NO: 211744 - RNA, 25 nt, Homo sapiens
acugcagccucaaccucauggguuc

SEQ ID NO: 211745 - RNA, 22 nt, Homo sapiens
uccacuuccuggguucaagcaa

SEQ ID NO: 211746 - RNA, 19 nt, Homo sapiens
cacugcaaccuccaucucc

SEQ ID NO: 211747 - RNA, 21 nt, Homo sapiens
cucaggcuggagugcaguggu

SEQ ID NO: 211748 - RNA, 22 nt, Homo sapiens
acuuacugcagccucaaccacc

SEQ ID NO: 211749 - RNA, 17 nt, Homo sapiens
gacagccucucccccac

SEQ ID NO: 211750 - RNA, 20 nt, Homo sapiens
ugucuccacagggcucuuua

SEQ ID NO: 211751 - RNA, 22 nt, Homo sapiens
aaaauacauauauaucuacgua

SEQ ID NO: 211752 - RNA, 22 nt, Homo sapiens
gcucuuuucauuaauguagaca

SEQ ID NO: 211753 - RNA, 22 nt, Homo sapiens
auagaugauaugcacaguacua

SEQ ID NO: 211754 - RNA, 17 nt, Homo sapiens
agaaagaagcaauauga

SEQ ID NO: 211755 - RNA, 17 nt, Homo sapiens
gggagaggaggaggcga

SEQ ID NO: 211756 - RNA, 20 nt, Homo sapiens
aagcagaaaaaggcaaacga

SEQ ID NO: 211757 - RNA, 22 nt, Homo sapiens
agaaagcgcuuuccuuuguaga

SEQ ID NO: 211758 - RNA, 22 nt, Homo sapiens
gaaaagccagggucuguauaga

SEQ ID NO: 211759 - RNA, 22 nt, Homo sapiens
aggucucacuuuguugcccaga

SEQ ID NO: 211760 - RNA, 21 nt, Homo sapiens
ccugggcaacaaagugagauc

SEQ ID NO: 211761 - RNA, 21 nt, Homo sapiens
agggcucaucuugguccugca

SEQ ID NO: 211762 - RNA, 22 nt, Homo sapiens
gacucgaaccacugauccagca

SEQ ID NO: 211763 - RNA, 21 nt, Homo sapiens
ucuccagaucagggcagucca

SEQ ID NO: 211764 - RNA, 23 nt, Homo sapiens
aaaaugcagauuccuggacucca

SEQ ID NO: 211765 - RNA, 19 nt, Homo sapiens
ucccugauccaaaaaucca

SEQ ID NO: 211766 - RNA, 24 nt, Homo sapiens
acugcuggucuucagucagggcca

SEQ ID NO: 211767 - RNA, 20 nt, Homo sapiens
gaacgggagccggggcgcga

SEQ ID NO: 211768 - RNA, 25 nt, Homo sapiens
cagcgucugccggaacccguuccca

SEQ ID NO: 211769 - RNA, 22 nt, Homo sapiens
gcacaaaucuccagaccaccca

SEQ ID NO: 211770 - RNA, 22 nt, Homo sapiens
agacaacaaugccaaccucaca

SEQ ID NO: 211771 - RNA, 21 nt, Homo sapiens
ucacccagaucugcggccuaa

SEQ ID NO: 211772 - RNA, 22 nt, Homo sapiens
uugcccagauccguggccuauu

SEQ ID NO: 211773 - RNA, 21 nt, Homo sapiens
auuaggccgcagaucugggug

SEQ ID NO: 211774 - RNA, 22 nt, Homo sapiens
ggagauggagccagggcccuaa

SEQ ID NO: 211775 - RNA, 17 nt, Homo sapiens
caccugaauuacuugaa

SEQ ID NO: 211776 - RNA, 22 nt, Homo sapiens
uacaucuggacagccgaaugaa

SEQ ID NO: 211777 - RNA, 22 nt, Homo sapiens
ucccucacacagaauuccagaa

SEQ ID NO: 211778 - RNA, 24 nt, Homo sapiens
gaagucacucccaggcagcugcaa

SEQ ID NO: 211779 - RNA, 21 nt, Homo sapiens
uuuagcauaaguaugucccaa

SEQ ID NO: 211780 - RNA, 22 nt, Homo sapiens
agagcaagaccccgucucuaaa

SEQ ID NO: 211781 - RNA, 22 nt, Homo sapiens
gggguucgaggcuacagugaga

SEQ ID NO: 211782 - RNA, 22 nt, Homo sapiens
cacaucucacuguagccucaaa

SEQ ID NO: 211783 - RNA, 22 nt, Homo sapiens
ucucucccauuagaguugaaaa

SEQ ID NO: 211784 - RNA, 18 nt, Homo sapiens
caccaccagagccaacgu

SEQ ID NO: 211785 - RNA, 22 nt, Homo sapiens
uggacguuugcaggggaggugg

SEQ ID NO: 211786 - RNA, 22 nt, Homo sapiens
cacgaccgacgccacgccgagu

SEQ ID NO: 211787 - RNA, 21 nt, Homo sapiens
agccggucgagguccggucga

SEQ ID NO: 211788 - RNA, 18 nt, Homo sapiens
aucacauucaccucccug

SEQ ID NO: 211789 - RNA, 19 nt, Homo sapiens
cagcaucagcagcaucauc

SEQ ID NO: 211790 - RNA, 22 nt, Homo sapiens
agaaaaugccccucaguuuuga

SEQ ID NO: 211791 - RNA, 24 nt, Homo sapiens
gaaagugcauagaauucugucugg

SEQ ID NO: 211792 - RNA, 22 nt, Homo sapiens
gcgagagugcgggccccaggag

SEQ ID NO: 211793 - RNA, 21 nt, Homo sapiens
cagcgaaacaggcaaacggag

SEQ ID NO: 211794 - RNA, 22 nt, Homo sapiens
ggagcccgcgccccgcgccgag

SEQ ID NO: 211795 - RNA, 21 nt, Homo sapiens
cggggugcacgggcggagggc

SEQ ID NO: 211796 - RNA, 22 nt, Homo sapiens
acaccuggcuccacacgcgggc

SEQ ID NO: 211797 - RNA, 22 nt, Homo sapiens
acaacuguaacuagacgguuuu

SEQ ID NO: 211798 - RNA, 23 nt, Homo sapiens
aggaacagcagcagcccgggccg

SEQ ID NO: 211799 - RNA, 21 nt, Homo sapiens
gggcaucugggacgcgcagga

SEQ ID NO: 211800 - RNA, 20 nt, Homo sapiens
cccaacccagcccagcccaa

SEQ ID NO: 211801 - RNA, 18 nt, Homo sapiens
ggagaggagggcacugga

SEQ ID NO: 211802 - RNA, 18 nt, Homo sapiens
auucaaucuacugccuca

SEQ ID NO: 211803 - RNA, 21 nt, Homo sapiens
gaccaaucgccguccccgccg

SEQ ID NO: 211804 - RNA, 22 nt, Homo sapiens
cggugagcacccggccccugcg

SEQ ID NO: 211805 - RNA, 21 nt, Homo sapiens
cagggcaggcaccggcacuca

SEQ ID NO: 211806 - RNA, 21 nt, Homo sapiens
aggcggcaggcacaggacugg

SEQ ID NO: 211807 - RNA, 20 nt, Homo sapiens
ggagaccacaaugccuggug

SEQ ID NO: 211808 - RNA, 23 nt, Homo sapiens
cccaacagacauggcgguacuca

SEQ ID NO: 211809 - RNA, 22 nt, Homo sapiens
uucacacugcaugcucugggua

SEQ ID NO: 211810 - RNA, 22 nt, Homo sapiens
uggcagcagcggagggggcaga

SEQ ID NO: 211811 - RNA, 22 nt, Homo sapiens
ccucccagugcgggaccccucc

SEQ ID NO: 211812 - RNA, 22 nt, Homo sapiens
cagaagugggccgggcacaggg

SEQ ID NO: 211813 - RNA, 20 nt, Homo sapiens
cccgccgcgucgcccugggg

SEQ ID NO: 211814 - RNA, 22 nt, Homo sapiens
ggcccgggcagcaaggcaaggu

SEQ ID NO: 211815 - RNA, 22 nt, Homo sapiens
ugagccacugugccuggccuga

SEQ ID NO: 211816 - RNA, 19 nt, Homo sapiens
uaugcuaccuuugcacggu

SEQ ID NO: 211817 - RNA, 20 nt, Homo sapiens
acagcaaggagggcaggagg

SEQ ID NO: 211818 - RNA, 20 nt, Homo sapiens
acauuacuguuaucaaaaca

SEQ ID NO: 211819 - RNA, 23 nt, Homo sapiens
guaaauagagguuuaauuaacac

SEQ ID NO: 211820 - RNA, 23 nt, Homo sapiens
aauaaauuaaauuuauauuacag

SEQ ID NO: 211821 - RNA, 22 nt, Homo sapiens
cacucagcggccguuuccccaa

SEQ ID NO: 211822 - RNA, 21 nt, Homo sapiens
gugacagagccaagcacaaau

SEQ ID NO: 211823 - RNA, 21 nt, Homo sapiens
aagucccuugcuugaggcucg

SEQ ID NO: 211824 - RNA, 22 nt, Homo sapiens
gaccgcuucaaggaagggacua

SEQ ID NO: 211825 - RNA, 22 nt, Homo sapiens
cuagccuccaugaauucugaug

SEQ ID NO: 211826 - RNA, 22 nt, Homo sapiens
uccaucaggagucauggaagcu

SEQ ID NO: 211827 - RNA, 21 nt, Homo sapiens
gggaguucuuggcaugggagg

SEQ ID NO: 211828 - RNA, 21 nt, Homo sapiens
agaccuccuaugcuaagaacc

SEQ ID NO: 211829 - RNA, 21 nt, Homo sapiens
cuguccuuggcaaagagaaca

SEQ ID NO: 211830 - RNA, 22 nt, Homo sapiens
ccucgccucugacacuugcaga

SEQ ID NO: 211831 - RNA, 21 nt, Homo sapiens
gagccaggcagggcgcuguca

SEQ ID NO: 211832 - RNA, 24 nt, Homo sapiens
gacuggcagcgcucagcccgcgcu

SEQ ID NO: 211833 - RNA, 22 nt, Homo sapiens
ccaggcaacacacacugcucuc

SEQ ID NO: 211834 - RNA, 22 nt, Homo sapiens
aucuccaaacagcaaggacaau

SEQ ID NO: 211835 - RNA, 21 nt, Homo sapiens
uuguccauuguaucuggggau

SEQ ID NO: 211836 - RNA, 20 nt, Homo sapiens
caccucucacccccauccua

SEQ ID NO: 211837 - RNA, 22 nt, Homo sapiens
ccugagccucucugccucugcu

SEQ ID NO: 211838 - RNA, 23 nt, Homo sapiens
gagccaaggcuaacagagccuca

SEQ ID NO: 211839 - RNA, 22 nt, Homo sapiens
gugcuuuaccaacuccaugaua

SEQ ID NO: 211840 - RNA, 22 nt, Homo sapiens
agucuccuggaggugguaaaac

SEQ ID NO: 211841 - RNA, 22 nt, Homo sapiens
ggaagacagcgcugaagaggcg

SEQ ID NO: 211842 - RNA, 23 nt, Homo sapiens
gacgucugaacagucacugccug

SEQ ID NO: 211843 - RNA, 19 nt, Homo sapiens
ccgcccaccgccaggcccc

SEQ ID NO: 211844 - RNA, 21 nt, Homo sapiens
ccaagagauguuggcccuaac

SEQ ID NO: 211845 - RNA, 23 nt, Homo sapiens
acugauuguccaaacgcaauucu

SEQ ID NO: 211846 - RNA, 22 nt, Homo sapiens
cgagaauuguggcuggacaucu

SEQ ID NO: 211847 - RNA, 23 nt, Homo sapiens
uguaagguguugcaguguggcaa

SEQ ID NO: 211848 - RNA, 21 nt, Homo sapiens
uugcacaccacaacagccaga

SEQ ID NO: 211849 - RNA, 23 nt, Homo sapiens
cuccaacaauauccuggugcuga

SEQ ID NO: 211850 - RNA, 23 nt, Homo sapiens
uccagcaucagugauuuuguuga

SEQ ID NO: 211851 - RNA, 22 nt, Homo sapiens
cggugccuacugagcugauauc

SEQ ID NO: 211852 - RNA, 21 nt, Homo sapiens
cuggcucaguucagcaggaac

SEQ ID NO: 211853 - RNA, 20 nt, Homo sapiens
accaacuaguaaacccauau

SEQ ID NO: 211854 - RNA, 22 nt, Homo sapiens
agucccuacuauguuccaggca

SEQ ID NO: 211855 - RNA, 21 nt, Homo sapiens
cuggcacuauaugaguccuau

SEQ ID NO: 211856 - RNA, 20 nt, Homo sapiens
auaugacucguauagugucu

SEQ ID NO: 211857 - RNA, 23 nt, Homo sapiens
agaauuuucauaaugcagucaca

SEQ ID NO: 211858 - RNA, 20 nt, Homo sapiens
gccaucaaaguuaaaagcca

SEQ ID NO: 211859 - RNA, 21 nt, Homo sapiens
ugccugucuacacuugcugug

SEQ ID NO: 211860 - RNA, 21 nt, Homo sapiens
uguacagcaggcacagacagg

SEQ ID NO: 211861 - RNA, 22 nt, Homo sapiens
uguccuuugccuacucuauuua

SEQ ID NO: 211862 - RNA, 22 nt, Homo sapiens
cuuaaauagaauaggcaaagga

SEQ ID NO: 211863 - RNA, 22 nt, Homo sapiens
aagaccguccucuugucccaac

SEQ ID NO: 211864 - RNA, 17 nt, Homo sapiens
gauuaaacaauucucug

SEQ ID NO: 211865 - RNA, 22 nt, Homo sapiens
acuucacgggagugaggaaagu

SEQ ID NO: 211866 - RNA, 21 nt, Homo sapiens
gacuuugccuucgcccgcgaa

SEQ ID NO: 211867 - RNA, 20 nt, Homo sapiens
ucucuccacagcuuccucua

SEQ ID NO: 211868 - RNA, 22 nt, Homo sapiens
ucugugugacggaugccagaug

SEQ ID NO: 211869 - RNA, 22 nt, Homo sapiens
ugcuucuggcaucugucccuca

SEQ ID NO: 211870 - RNA, 22 nt, Homo sapiens
ccagcaggccugcagaagggga

SEQ ID NO: 211871 - RNA, 23 nt, Homo sapiens
cuucccauuccacaagcccugau

SEQ ID NO: 211872 - RNA, 23 nt, Homo sapiens
augagaguuuuuuacuugccaga

SEQ ID NO: 211873 - RNA, 22 nt, Homo sapiens
gcagcaguguagagauuaguuu

SEQ ID NO: 211874 - RNA, 22 nt, Homo sapiens
aaaccaaucucuacacuacugc

SEQ ID NO: 211875 - RNA, 21 nt, Homo sapiens
uuacccagucuccggugcagc

SEQ ID NO: 211876 - RNA, 21 nt, Homo sapiens
ggcugcaccggagacugggua

SEQ ID NO: 211877 - RNA, 23 nt, Homo sapiens
aaggcccuuccaccaguccucga

SEQ ID NO: 211878 - RNA, 24 nt, Homo sapiens
uccucugagcuccuucucuaccca

SEQ ID NO: 211879 - RNA, 22 nt, Homo sapiens
auuggguuuuaagaguucuuua

SEQ ID NO: 211880 - RNA, 23 nt, Homo sapiens
aauauguagucuuuuauccauca

SEQ ID NO: 211881 - RNA, 22 nt, Homo sapiens
cacugcagucucagccuaggca

SEQ ID NO: 211882 - RNA, 22 nt, Homo sapiens
caccacugcacucgcuccagcc

SEQ ID NO: 211883 - RNA, 22 nt, Homo sapiens
acuaacugaauagguugggcca

SEQ ID NO: 211884 - RNA, 23 nt, Homo sapiens
aaugacccuaccuauucagucag

SEQ ID NO: 211885 - RNA, 24 nt, Homo sapiens
accccauugcucccaggcuacaga

SEQ ID NO: 211886 - RNA, 24 nt, Homo sapiens
acucccucuaccucacuguccaca

SEQ ID NO: 211887 - RNA, 23 nt, Homo sapiens
aacaggcaucuguugagcuccua

SEQ ID NO: 211888 - RNA, 22 nt, Homo sapiens
acuaccugaauucccaaaagcu

SEQ ID NO: 211889 - RNA, 21 nt, Homo sapiens
aaagcuuuugguaauucaggu

SEQ ID NO: 211890 - RNA, 19 nt, Homo sapiens
uccuccuccacccgcccuc

SEQ ID NO: 211891 - RNA, 22 nt, Homo sapiens
ucugaagguucagaaaggccuu

SEQ ID NO: 211892 - RNA, 25 nt, Homo sapiens
cgaaagaagcgcuuuacaauguuau

SEQ ID NO: 211893 - RNA, 22 nt, Homo sapiens
uaaagagaccgaacagguauau

SEQ ID NO: 211894 - RNA, 22 nt, Homo sapiens
cuauauaucucuuugguccccu

SEQ ID NO: 211895 - RNA, 24 nt, Homo sapiens
caauuccaaacacucaaaauaucu

SEQ ID NO: 211896 - RNA, 22 nt, Homo sapiens
ugaguuuugaguguuuggaguu

SEQ ID NO: 211897 - RNA, 22 nt, Homo sapiens
ccauucuuucuauccuagcaug

SEQ ID NO: 211898 - RNA, 24 nt, Homo sapiens
ucacacccuccucacugcccaacc

SEQ ID NO: 211899 - RNA, 22 nt, Homo sapiens
aagcacacaccaguuuuuucca

SEQ ID NO: 211900 - RNA, 23 nt, Homo sapiens
auacacacacauauccauacaaa

SEQ ID NO: 211901 - RNA, 22 nt, Homo sapiens
ccaaccucgaggaucuccccag

SEQ ID NO: 211902 - RNA, 22 nt, Homo sapiens
gcugaggagaucgucgagguug

SEQ ID NO: 211903 - RNA, 21 nt, Homo sapiens
ccaaccucgacgaucuccuca

SEQ ID NO: 211904 - RNA, 22 nt, Homo sapiens
gcuggggagauccucgagguug

SEQ ID NO: 211905 - RNA, 21 nt, Homo sapiens
accugaucccauugccccacc

SEQ ID NO: 211906 - RNA, 22 nt, Homo sapiens
uuauugccccuauucuaacaca

SEQ ID NO: 211907 - RNA, 22 nt, Homo sapiens
cuuguguuagaacagaggcaau

SEQ ID NO: 211908 - RNA, 23 nt, Homo sapiens
aaaugucccuacucgcuuucccc

SEQ ID NO: 211909 - RNA, 22 nt, Homo sapiens
ucugcucccaacuccccuucug

SEQ ID NO: 211910 - RNA, 21 nt, Homo sapiens
aguucccacugcagagccugg

SEQ ID NO: 211911 - RNA, 18 nt, Homo sapiens
ucccacugcagagccugg

SEQ ID NO: 211912 - RNA, 21 nt, Homo sapiens
agaaagaucuggaagugggag

SEQ ID NO: 211913 - RNA, 22 nt, Homo sapiens
ugucucccacuuccagaucuuu

SEQ ID NO: 211914 - RNA, 22 nt, Homo sapiens
agcuucagcuagacuagggcag

SEQ ID NO: 211915 - RNA, 22 nt, Homo sapiens
agacugcacuagccuggcugaa

SEQ ID NO: 211916 - RNA, 22 nt, Homo sapiens
guccugcagagaggaagcccuu

SEQ ID NO: 211917 - RNA, 21 nt, Homo sapiens
gaagggcuuccucucugcagg

SEQ ID NO: 211918 - RNA, 22 nt, Homo sapiens
guggccgacacuuguaauccua

SEQ ID NO: 211919 - RNA, 22 nt, Homo sapiens
ugggcuuucuagucucagcucu

SEQ ID NO: 211920 - RNA, 22 nt, Homo sapiens
ggagagcugagacuagaaagcc

SEQ ID NO: 211921 - RNA, 23 nt, Homo sapiens
aucugggccucuguucuuaucag

SEQ ID NO: 211922 - RNA, 21 nt, Homo sapiens
uggggaguggagggguaggga

SEQ ID NO: 211923 - RNA, 23 nt, Homo sapiens
cuccccacccuucuacucccuaa

SEQ ID NO: 211924 - RNA, 22 nt, Homo sapiens
gucuuacugcccucauuuuaua

SEQ ID NO: 211925 - RNA, 22 nt, Homo sapiens
cgccauuucccuuaaagucaca

SEQ ID NO: 211926 - RNA, 22 nt, Homo sapiens
ugaggucacauugcauccaccu

SEQ ID NO: 211927 - RNA, 23 nt, Homo sapiens
uaggccaguaggcauugucugcg

SEQ ID NO: 211928 - RNA, 22 nt, Homo sapiens
acaccaguauuucugaaauccu

SEQ ID NO: 211929 - RNA, 17 nt, Homo sapiens
gucugacuguagaacuc

SEQ ID NO: 211930 - RNA, 22 nt, Homo sapiens
cuaugugccaagcacaguccua

SEQ ID NO: 211931 - RNA, 22 nt, Homo sapiens
acugucugucucagaaccccag

SEQ ID NO: 211932 - RNA, 24 nt, Homo sapiens
gauauauacagauuccauacaucu

SEQ ID NO: 211933 - RNA, 22 nt, Homo sapiens
uggccugccuauuuccuccuuu

SEQ ID NO: 211934 - RNA, 22 nt, Homo sapiens
aaaggagaaaacaggcagggca

SEQ ID NO: 211935 - RNA, 23 nt, Homo sapiens
ggcucugcaucucuaacucacua

SEQ ID NO: 211936 - RNA, 22 nt, Homo sapiens
acgucacugcguucucuccccg

SEQ ID NO: 211937 - RNA, 19 nt, Homo sapiens
ccgguagucccaggccagu

SEQ ID NO: 211938 - RNA, 21 nt, Homo sapiens
acguguccccagugccgugca

SEQ ID NO: 211939 - RNA, 23 nt, Homo sapiens
agcgccuggcacguguguacaca

SEQ ID NO: 211940 - RNA, 17 nt, Homo sapiens
cgauccggccgcgcccc

SEQ ID NO: 211941 - RNA, 22 nt, Homo sapiens
acguuuaaauuucaccccuucu

SEQ ID NO: 211942 - RNA, 19 nt, Homo sapiens
cuccggaagcuccgcccca

SEQ ID NO: 211943 - RNA, 22 nt, Homo sapiens
ggccuccggaagcuccgcccca

SEQ ID NO: 211944 - RNA, 25 nt, Homo sapiens
cgacguggggcggagcgucuggaag

SEQ ID NO: 211945 - RNA, 19 nt, Homo sapiens
ccggcgccgagggcccgau

SEQ ID NO: 211946 - RNA, 17 nt, Homo sapiens
gacuacacuacagaagc

SEQ ID NO: 211947 - RNA, 22 nt, Homo sapiens
uccgagcgacuccgagagaggc

SEQ ID NO: 211948 - RNA, 23 nt, Homo sapiens
ugaggggcagagagcgagacuuu

SEQ ID NO: 211949 - RNA, 24 nt, Homo sapiens
aaaagcucggucugaggccccuca

SEQ ID NO: 211950 - RNA, 23 nt, Homo sapiens
ccgcagaccgaccgccuucuucu

SEQ ID NO: 211951 - RNA, 21 nt, Homo sapiens
caaagccaucucuccgcguga

SEQ ID NO: 211952 - RNA, 22 nt, Homo sapiens
aagccacguagacagacgccug

SEQ ID NO: 211953 - RNA, 20 nt, Homo sapiens
ccgcgcagccccauggccaa

SEQ ID NO: 211954 - RNA, 23 nt, Homo sapiens
ccuucagccacacgcugcccagg

SEQ ID NO: 211955 - RNA, 23 nt, Homo sapiens
ccccguauccgcacaaagccucu

SEQ ID NO: 211956 - RNA, 21 nt, Homo sapiens
cuaccccaucagacccaaggg

SEQ ID NO: 211957 - RNA, 25 nt, Homo sapiens
uccuacccagggcacagauggggca

SEQ ID NO: 211958 - RNA, 23 nt, Homo sapiens
ucucuggccgucuaccuuccaca

SEQ ID NO: 211959 - RNA, 20 nt, Homo sapiens
uggggacguagcuggccaga

SEQ ID NO: 211960 - RNA, 23 nt, Homo sapiens
cugucuggccagcuacgucccca

SEQ ID NO: 211961 - RNA, 22 nt, Homo sapiens
uggaagguagacggccagagag

SEQ ID NO: 211962 - RNA, 23 nt, Homo sapiens
uuccacugcuacaaccucccaga

SEQ ID NO: 211963 - RNA, 22 nt, Homo sapiens
acuccucagauccuacgcagga

SEQ ID NO: 211964 - RNA, 22 nt, Homo sapiens
acugccagugagcagcagagcu

SEQ ID NO: 211965 - RNA, 21 nt, Homo sapiens
cagcccuccugguggcuggcc

SEQ ID NO: 211966 - RNA, 17 nt, Homo sapiens
aacccgggcccggcgcg

SEQ ID NO: 211967 - RNA, 18 nt, Homo sapiens
gaggccccugccgccccg

SEQ ID NO: 211968 - RNA, 23 nt, Homo sapiens
cgccuuuccgagccugcgccucc

SEQ ID NO: 211969 - RNA, 22 nt, Homo sapiens
ucuccauuccccaggacuccac

SEQ ID NO: 211970 - RNA, 23 nt, Homo sapiens
aacuuucuccuaaggcagucccu

SEQ ID NO: 211971 - RNA, 22 nt, Homo sapiens
cagaccugaguagcgcaaggug

SEQ ID NO: 211972 - RNA, 22 nt, Homo sapiens
accuugugcgccuucucagauu

SEQ ID NO: 211973 - RNA, 17 nt, Homo sapiens
auuuuucuucauauccc

SEQ ID NO: 211974 - RNA, 22 nt, Homo sapiens
auuaaagcucuucucccuucca

SEQ ID NO: 211975 - RNA, 24 nt, Homo sapiens
uggaagacuagugauuuuguuguu

SEQ ID NO: 211976 - RNA, 22 nt, Homo sapiens
aacaacaaaucccagucuaccu

SEQ ID NO: 211977 - RNA, 22 nt, Homo sapiens
guggagugugacaaugguguuu

SEQ ID NO: 211978 - RNA, 23 nt, Homo sapiens
ucaaacgccauuaucacacuaaa

SEQ ID NO: 211979 - RNA, 23 nt, Homo sapiens
cuagaggacagguaacacggagg

SEQ ID NO: 211980 - RNA, 23 nt, Homo sapiens
ggcuuccuugcuauccauccuca

SEQ ID NO: 211981 - RNA, 21 nt, Homo sapiens
cuaaguagugaaagaaauuuu

SEQ ID NO: 211982 - RNA, 21 nt, Homo sapiens
aauuaaaauagccuucacuaa

SEQ ID NO: 211983 - RNA, 20 nt, Homo sapiens
caucagaaagcguuuacagu

SEQ ID NO: 211984 - RNA, 22 nt, Homo sapiens
acugauuugcuucaucacaugc

SEQ ID NO: 211985 - RNA, 24 nt, Homo sapiens
cagccaguauuacucaucacuuug

SEQ ID NO: 211986 - RNA, 20 nt, Homo sapiens
cggcgccuccuuuccgauuc

SEQ ID NO: 211987 - RNA, 21 nt, Homo sapiens
uaagaauuucuuucuucacaa

SEQ ID NO: 211988 - RNA, 22 nt, Homo sapiens
uccauuucucaagaugccuccu

SEQ ID NO: 211989 - RNA, 24 nt, Homo sapiens
gaaggguugggcuuuuuuuuuugu

SEQ ID NO: 211990 - RNA, 22 nt, Homo sapiens
gaacaaaaaaaaaaguacaaca

SEQ ID NO: 211991 - RNA, 23 nt, Homo sapiens
aaaacaccaagaucugaaggcua

SEQ ID NO: 211992 - RNA, 23 nt, Homo sapiens
gggcagccuucagauccaagugg

SEQ ID NO: 211993 - RNA, 21 nt, Homo sapiens
gagccgcgaggagccgagaga

SEQ ID NO: 211994 - RNA, 23 nt, Homo sapiens
gccugcaucaugaaaugcccucg

SEQ ID NO: 211995 - RNA, 22 nt, Homo sapiens
acauaucaugagugcacuucau

SEQ ID NO: 211996 - RNA, 23 nt, Homo sapiens
agaaaggacauagggugcugaug

SEQ ID NO: 211997 - RNA, 22 nt, Homo sapiens
cccaucuugcaacuaugucuuu

SEQ ID NO: 211998 - RNA, 22 nt, Homo sapiens
gcucuuuucauuaauguagaca

SEQ ID NO: 211999 - RNA, 22 nt, Homo sapiens
ccacagcaggcaggaugguccc

SEQ ID NO: 212000 - RNA, 22 nt, Homo sapiens
gcugcaccagccugccugcuga

SEQ ID NO: 212001 - RNA, 22 nt, Homo sapiens
cugggugcgggaugcaggguga

SEQ ID NO: 212002 - RNA, 22 nt, Homo sapiens
ggcccagcccagcccagcccac

SEQ ID NO: 212003 - RNA, 20 nt, Homo sapiens
ccugcagaccccgacccgcg

SEQ ID NO: 212004 - RNA, 22 nt, Homo sapiens
acaggcaugggaggucagguga

SEQ ID NO: 212005 - RNA, 22 nt, Homo sapiens
cucaccugagcucccgugccug

SEQ ID NO: 212006 - RNA, 21 nt, Homo sapiens
caggcacgggagcucagguga

SEQ ID NO: 212007 - RNA, 20 nt, Homo sapiens
ucaccugaccucccaugccu

SEQ ID NO: 212008 - RNA, 22 nt, Homo sapiens
ugggcugggcucauuucauuuu

SEQ ID NO: 212009 - RNA, 21 nt, Homo sapiens
cccucggcgauccccgcggcu

SEQ ID NO: 212010 - RNA, 19 nt, Homo sapiens
cuuagacacucaggucccu

SEQ ID NO: 212011 - RNA, 19 nt, Homo sapiens
ggacucuacagacacaccu

SEQ ID NO: 212012 - RNA, 24 nt, Homo sapiens
ucauguaccagcgaccgggcuaug

SEQ ID NO: 212013 - RNA, 18 nt, Homo sapiens
uccucacaccuccagccg

SEQ ID NO: 212014 - RNA, 18 nt, Homo sapiens
cuucagucaacuucuuag

SEQ ID NO: 212015 - RNA, 19 nt, Homo sapiens
uuccucagcuuguccaguc

SEQ ID NO: 212016 - RNA, 21 nt, Homo sapiens
agcaacaccgcagcgacaagc

SEQ ID NO: 212017 - RNA, 17 nt, Homo sapiens
ccacccccgcacccgcc

SEQ ID NO: 212018 - RNA, 21 nt, Homo sapiens
aaucaccaauaaugggacaca

SEQ ID NO: 212019 - RNA, 22 nt, Homo sapiens
aucuccaugguguuuucuuaaa

SEQ ID NO: 212020 - RNA, 21 nt, Homo sapiens
ugcccucguagacaacacuca

SEQ ID NO: 212021 - RNA, 21 nt, Homo sapiens
ucaaaaugcucuccugucagu

SEQ ID NO: 212022 - RNA, 22 nt, Homo sapiens
cagcuguccgagucccagguca

SEQ ID NO: 212023 - RNA, 24 nt, Homo sapiens
caucagucacuacucaucauuuuc

SEQ ID NO: 212024 - RNA, 23 nt, Homo sapiens
gcgcccggccuguguggugcuca

SEQ ID NO: 212025 - RNA, 21 nt, Homo sapiens
ccgagcaccacgcagaccagc

SEQ ID NO: 212026 - RNA, 22 nt, Homo sapiens
aacucugucuuuacuccugaga

SEQ ID NO: 212027 - RNA, 22 nt, Homo sapiens
acucaugagugaagacagaguu

SEQ ID NO: 212028 - RNA, 18 nt, Homo sapiens
cgccgccccgcaccugcu

SEQ ID NO: 212029 - RNA, 21 nt, Homo sapiens
ucggcaucuacacuugcacug

SEQ ID NO: 212030 - RNA, 22 nt, Homo sapiens
aaagacccauggagaggaaggu

SEQ ID NO: 212031 - RNA, 22 nt, Homo sapiens
accuucuccucaaugggucuuu

SEQ ID NO: 212032 - RNA, 21 nt, Homo sapiens
auuuugaucaaucucuacauu

SEQ ID NO: 212033 - RNA, 23 nt, Homo sapiens
uauauuccguauacauauuccgu

SEQ ID NO: 212034 - RNA, 24 nt, Homo sapiens
uagagaaggacagcugugagcucu

SEQ ID NO: 212035 - RNA, 22 nt, Homo sapiens
ugcagacuaguccuuauuugau

SEQ ID NO: 212036 - RNA, 23 nt, Homo sapiens
aagauguuuuacaugagucucau

SEQ ID NO: 212037 - RNA, 21 nt, Homo sapiens
uauuccguauauacauuccau

SEQ ID NO: 212038 - RNA, 22 nt, Homo sapiens
ggccaaucuuagguucuacaau

SEQ ID NO: 212039 - RNA, 22 nt, Homo sapiens
uugggggaguuccuuagagaug

SEQ ID NO: 212040 - RNA, 23 nt, Homo sapiens
gaaaucucuacagaagccccaua

SEQ ID NO: 212041 - RNA, 20 nt, Homo sapiens
aaagcgugggggaaacacgg

SEQ ID NO: 212042 - RNA, 15 nt, Homo sapiens
aacccaggaucuccu

SEQ ID NO: 212043 - RNA, 22 nt, Homo sapiens
ggccguggccagagcccacgag

SEQ ID NO: 212044 - RNA, 22 nt, Homo sapiens
cacugcagggcucuggccacug

SEQ ID NO: 212045 - RNA, 22 nt, Homo sapiens
ccgguccguacaaacucugcag

SEQ ID NO: 212046 - RNA, 20 nt, Homo sapiens
cacagcagaguuuguacgga

SEQ ID NO: 212047 - RNA, 22 nt, Homo sapiens
gaugaagauuacuggggggaag

SEQ ID NO: 212048 - RNA, 23 nt, Homo sapiens
uccccuucccugccauauccuca

SEQ ID NO: 212049 - RNA, 23 nt, Homo sapiens
ccuacucccagggucaugcaaaa

SEQ ID NO: 212050 - RNA, 22 nt, Homo sapiens
ugcacaauccugugagugaguc

SEQ ID NO: 212051 - RNA, 22 nt, Homo sapiens
aguaguggaugaagcacugugu

SEQ ID NO: 212052 - RNA, 22 nt, Homo sapiens
gcacagagugcaucauccacua

SEQ ID NO: 212053 - RNA, 21 nt, Homo sapiens
cuaccuccaccuguaucauca

SEQ ID NO: 212054 - RNA, 22 nt, Homo sapiens
augauaacacagguagaaguag

SEQ ID NO: 212055 - RNA, 22 nt, Homo sapiens
ugauacuacuuccaaugucgca

SEQ ID NO: 212056 - RNA, 21 nt, Homo sapiens
aaggacguguacuaggucuaa

SEQ ID NO: 212057 - RNA, 22 nt, Homo sapiens
agucuucagguaggguaggaaa

SEQ ID NO: 212058 - RNA, 22 nt, Homo sapiens
ucauuuacuuucucuuacagau

SEQ ID NO: 212059 - RNA, 24 nt, Homo sapiens
acgucgcacgaacgccuguccggg

SEQ ID NO: 212060 - RNA, 22 nt, Homo sapiens
agaguggcaaagucuuuccaua

SEQ ID NO: 212061 - RNA, 21 nt, Homo sapiens
auauggaaagacuuugccacu

SEQ ID NO: 212062 - RNA, 22 nt, Homo sapiens
accacgauaucacaccucccag

SEQ ID NO: 212063 - RNA, 22 nt, Homo sapiens
ucccaggaaccaugauaucaca

SEQ ID NO: 212064 - RNA, 22 nt, Homo sapiens
accacaauaucacaccucccag

SEQ ID NO: 212065 - RNA, 22 nt, Homo sapiens
ucccaggaaccaugauaucaca

SEQ ID NO: 212066 - RNA, 22 nt, Homo sapiens
accacaauaucacaccucccag

SEQ ID NO: 212067 - RNA, 22 nt, Homo sapiens
cgagugugagaucacaccuccc

SEQ ID NO: 212068 - RNA, 22 nt, Homo sapiens
ucccaggaaccaugauaucaca

SEQ ID NO: 212069 - RNA, 22 nt, Homo sapiens
ucccaggaagcacgauaucaca

SEQ ID NO: 212070 - RNA, 23 nt, Homo sapiens
cuuugucuacgcuggguccaggu

SEQ ID NO: 212071 - RNA, 22 nt, Homo sapiens
gagaggaugacgcagacuuggu

SEQ ID NO: 212072 - RNA, 23 nt, Homo sapiens
guaccgagucuccaucauccacu

SEQ ID NO: 212073 - RNA, 24 nt, Homo sapiens
acuucugcagugucaguguggaac

SEQ ID NO: 212074 - RNA, 24 nt, Homo sapiens
caguauccacuccugaccagcagg

SEQ ID NO: 212075 - RNA, 20 nt, Homo sapiens
accauccccaaacggauacc

SEQ ID NO: 212076 - RNA, 22 nt, Homo sapiens
acaggggagcacugcugccuuc

SEQ ID NO: 212077 - RNA, 22 nt, Homo sapiens
ugugagccagccuggagcaccu

SEQ ID NO: 212078 - RNA, 22 nt, Homo sapiens
aaacagucuaccuacauugcuc

SEQ ID NO: 212079 - RNA, 22 nt, Homo sapiens
agacugcaggcccuagaggaca

SEQ ID NO: 212080 - RNA, 20 nt, Homo sapiens
ugucuugguuuuaugccuuu

SEQ ID NO: 212081 - RNA, 22 nt, Homo sapiens
ugccuccuccaggauccacaca

SEQ ID NO: 212082 - RNA, 21 nt, Homo sapiens
acauguccauauuaugcguua

SEQ ID NO: 212083 - RNA, 22 nt, Homo sapiens
uuugggacugaucuugaugucu

SEQ ID NO: 212084 - RNA, 22 nt, Homo sapiens
agacaucaagaucagucccaaa

SEQ ID NO: 212085 - RNA, 22 nt, Homo sapiens
acuucucauuuucugguuccuu

SEQ ID NO: 212086 - RNA, 22 nt, Homo sapiens
aauaagaccaucuuuuccucaa

SEQ ID NO: 212087 - RNA, 26 nt, Homo sapiens
cugagaaccagccauuucuuccucuu

SEQ ID NO: 212088 - RNA, 20 nt, Homo sapiens
cccaccugcucaguccgagc

SEQ ID NO: 212089 - RNA, 21 nt, Homo sapiens
agucuccaucugcggcccugu

SEQ ID NO: 212090 - RNA, 21 nt, Homo sapiens
acugaguccuuuguucucugc

SEQ ID NO: 212091 - RNA, 22 nt, Homo sapiens
ucagagaguuaagauaaucagu

SEQ ID NO: 212092 - RNA, 23 nt, Homo sapiens
acaaggcauaugguacucagaga

SEQ ID NO: 212093 - RNA, 22 nt, Homo sapiens
aaagagucaagucaaggccaga

SEQ ID NO: 212094 - RNA, 23 nt, Homo sapiens
ugcugugggaccucuggccuuga

SEQ ID NO: 212095 - RNA, 22 nt, Homo sapiens
cccuaauccaacauuacuaguu

SEQ ID NO: 212096 - RNA, 22 nt, Homo sapiens
aguagcagucacauauacauau

SEQ ID NO: 212097 - RNA, 21 nt, Homo sapiens
caagagaacuaaaacuggagu

SEQ ID NO: 212098 - RNA, 22 nt, Homo sapiens
aggcuccacuuucaguucucuu

SEQ ID NO: 212099 - RNA, 21 nt, Homo sapiens
ucucugccugcuuuuuggcca

SEQ ID NO: 212100 - RNA, 22 nt, Homo sapiens
augccuaucaaauaucuaccug

SEQ ID NO: 212101 - RNA, 21 nt, Homo sapiens
acaggcagauaugugauaggc

SEQ ID NO: 212102 - RNA, 22 nt, Homo sapiens
gccgaagcuccaagguuccucc

SEQ ID NO: 212103 - RNA, 23 nt, Homo sapiens
aguggucuacucacaucagccuc

SEQ ID NO: 212104 - RNA, 22 nt, Homo sapiens
ucccagcugugcaaccugagca

SEQ ID NO: 212105 - RNA, 22 nt, Homo sapiens
cugccucaguuuccacaccuga

SEQ ID NO: 212106 - RNA, 22 nt, Homo sapiens
guggcuggugcucguaucuaca

SEQ ID NO: 212107 - RNA, 22 nt, Homo sapiens
ugcaucugccauacaccccuua

SEQ ID NO: 212108 - RNA, 23 nt, Homo sapiens
cccccauugcuacagccgccugu

SEQ ID NO: 212109 - RNA, 22 nt, Homo sapiens
ccggguuaucuacaagggaauu

SEQ ID NO: 212110 - RNA, 22 nt, Homo sapiens
gacauccuguggucugcgcgua

SEQ ID NO: 212111 - RNA, 22 nt, Homo sapiens
aagugggcugggauccgggcug

SEQ ID NO: 212112 - RNA, 20 nt, Homo sapiens
cagagcccgccccaacccac

SEQ ID NO: 212113 - RNA, 22 nt, Homo sapiens
uaugauccucaguuguguguaa

SEQ ID NO: 212114 - RNA, 21 nt, Homo sapiens
auguaauacuguuaucugaaa

SEQ ID NO: 212115 - RNA, 22 nt, Homo sapiens
auuucagguaacaguauugcuu

SEQ ID NO: 212116 - RNA, 23 nt, Homo sapiens
cgccaagugaagccugggggcua

SEQ ID NO: 212117 - RNA, 23 nt, Homo sapiens
ccggagcagcaggccagcccgaa

SEQ ID NO: 212118 - RNA, 21 nt, Homo sapiens
ucucgguuggccugcugcaca

SEQ ID NO: 212119 - RNA, 23 nt, Homo sapiens
auaucaacccucuccuaugcccu

SEQ ID NO: 212120 - RNA, 20 nt, Homo sapiens
cccccgccuccgccgccgcc

SEQ ID NO: 212121 - RNA, 22 nt, Homo sapiens
ugcccuggaacggggcuggcag

SEQ ID NO: 212122 - RNA, 23 nt, Homo sapiens
cuaaggcuaaugcuguacuuugu

SEQ ID NO: 212123 - RNA, 23 nt, Homo sapiens
gcauuaaccuuacaaugaccuuu

SEQ ID NO: 212124 - RNA, 22 nt, Homo sapiens
gugaaguagugcauuagccuca

SEQ ID NO: 212125 - RNA, 24 nt, Homo sapiens
acauuaaucuuccugcucucuaua

SEQ ID NO: 212126 - RNA, 23 nt, Homo sapiens
uaagguuaauuacgaugaagcac

SEQ ID NO: 212127 - RNA, 24 nt, Homo sapiens
acacccuggaugcaugcuuuccac

SEQ ID NO: 212128 - RNA, 17 nt, Homo sapiens
uuggcccuuuucucagg

SEQ ID NO: 212129 - RNA, 19 nt, Homo sapiens
uggugcugacucaguggcc

SEQ ID NO: 212130 - RNA, 18 nt, Homo sapiens
acccccuggacaugcccu

SEQ ID NO: 212131 - RNA, 23 nt, Homo sapiens
gagaugguggaguagcuccaggc

SEQ ID NO: 212132 - RNA, 17 nt, Homo sapiens
uccaucucugaacacug

SEQ ID NO: 212133 - RNA, 18 nt, Homo sapiens
accuucaucaggucagau

SEQ ID NO: 212134 - RNA, 18 nt, Homo sapiens
cucaguccccaccucugg

SEQ ID NO: 212135 - RNA, 17 nt, Homo sapiens
ccaaggcgguggcgggg

SEQ ID NO: 212136 - RNA, 22 nt, Homo sapiens
uccugaccccuagacccaacug

SEQ ID NO: 212137 - RNA, 19 nt, Homo sapiens
ugggacuccaugccccaag

SEQ ID NO: 212138 - RNA, 16 nt, Homo sapiens
ugggucccuguuuccu

SEQ ID NO: 212139 - RNA, 17 nt, Homo sapiens
cagguagucugaauguc

SEQ ID NO: 212140 - RNA, 18 nt, Homo sapiens
ggccaaggcacuuagaau

SEQ ID NO: 212141 - RNA, 17 nt, Homo sapiens
aaugaccaugacugagu

SEQ ID NO: 212142 - RNA, 19 nt, Homo sapiens
cccagagcugagcccacag

SEQ ID NO: 212143 - RNA, 16 nt, Homo sapiens
ggccaaggccuccuag

SEQ ID NO: 212144 - RNA, 16 nt, Homo sapiens
gugccaccgagcugga

SEQ ID NO: 212145 - RNA, 21 nt, Homo sapiens
cacauccugagaggaggagcc

SEQ ID NO: 212146 - RNA, 21 nt, Homo sapiens
gccagggcugucugugccugc

SEQ ID NO: 212147 - RNA, 20 nt, Homo sapiens
gcccuccccugacucccuga

SEQ ID NO: 212148 - RNA, 19 nt, Homo sapiens
ccccaccuuuucuuccccc

SEQ ID NO: 212149 - RNA, 18 nt, Homo sapiens
acaaucacuaguugaaug

SEQ ID NO: 212150 - RNA, 18 nt, Homo sapiens
cuguccaucagagaacac

SEQ ID NO: 212151 - RNA, 18 nt, Homo sapiens
cagggggagggacugcug

SEQ ID NO: 212152 - RNA, 17 nt, Homo sapiens
aaagaagugguaauugg

SEQ ID NO: 212153 - RNA, 17 nt, Homo sapiens
gcacaugagucacugag

SEQ ID NO: 212154 - RNA, 21 nt, Homo sapiens
guguacugugcucagaacugc

SEQ ID NO: 212155 - RNA, 18 nt, Homo sapiens
caagggcaaacccccuag

SEQ ID NO: 212156 - RNA, 16 nt, Homo sapiens
gaagccgggaggagag

SEQ ID NO: 212157 - RNA, 21 nt, Homo sapiens
gcucugcucagaacuacacuc

SEQ ID NO: 212158 - RNA, 18 nt, Homo sapiens
ccccccuccccgggaccc

SEQ ID NO: 212159 - RNA, 18 nt, Homo sapiens
uccuggaugcaaauuuua

SEQ ID NO: 212160 - RNA, 17 nt, Homo sapiens
aaacucgcugagcccca

SEQ ID NO: 212161 - RNA, 18 nt, Homo sapiens
auggggugaugugagccc

SEQ ID NO: 212162 - RNA, 18 nt, Homo sapiens
augagucggacucgccgc

SEQ ID NO: 212163 - RNA, 17 nt, Homo sapiens
gguaccaggaguggggu

SEQ ID NO: 212164 - RNA, 19 nt, Homo sapiens
aaagugcccucaagggaga

SEQ ID NO: 212165 - RNA, 17 nt, Homo sapiens
ggaaacucagcagacaa

SEQ ID NO: 212166 - RNA, 19 nt, Homo sapiens
ugauagcccugcacaaugc

SEQ ID NO: 212167 - RNA, 19 nt, Homo sapiens
gagggaagaaaggagggca

SEQ ID NO: 212168 - RNA, 16 nt, Homo sapiens
agcuguuccugcugaa

SEQ ID NO: 212169 - RNA, 18 nt, Homo sapiens
ccaaggccggcccagggg

SEQ ID NO: 212170 - RNA, 17 nt, Homo sapiens
cuguuccugucaggcug

SEQ ID NO: 212171 - RNA, 17 nt, Homo sapiens
cccugcuguagacuccc

SEQ ID NO: 212172 - RNA, 18 nt, Homo sapiens
aaggaaaacauugcacug

SEQ ID NO: 212173 - RNA, 17 nt, Homo sapiens
ugagccugagcccacau

SEQ ID NO: 212174 - RNA, 16 nt, Homo sapiens
cacagacaggaaggca

SEQ ID NO: 212175 - RNA, 22 nt, Homo sapiens
cugccuccuccuccugucccag

SEQ ID NO: 212176 - RNA, 18 nt, Homo sapiens
gccucucaugucaccagc

SEQ ID NO: 212177 - RNA, 18 nt, Homo sapiens
gaaguaguccagcuccca

SEQ ID NO: 212178 - RNA, 20 nt, Homo sapiens
ucacaagugaaguaguggga

SEQ ID NO: 212179 - RNA, 18 nt, Homo sapiens
cucgcugagccacacugg

SEQ ID NO: 212180 - RNA, 17 nt, Homo sapiens
cuguccucagcucagaa

SEQ ID NO: 212181 - RNA, 17 nt, Homo sapiens
ugcccuggacaugccgg

SEQ ID NO: 212182 - RNA, 18 nt, Homo sapiens
gaacuggaggugucuagg

SEQ ID NO: 212183 - RNA, 17 nt, Homo sapiens
uacugccuuucucucca

SEQ ID NO: 212184 - RNA, 19 nt, Homo sapiens
ggaaacaggaaaaaacauu

SEQ ID NO: 212185 - RNA, 18 nt, Homo sapiens
aagaagaaacuccaggga

SEQ ID NO: 212186 - RNA, 18 nt, Homo sapiens
uggaauccuagacuccag

SEQ ID NO: 212187 - RNA, 16 nt, Homo sapiens
gggacaugaaugcugc

SEQ ID NO: 212188 - RNA, 18 nt, Homo sapiens
cacacucagcucucuuuc

SEQ ID NO: 212189 - RNA, 19 nt, Homo sapiens
uggggacaggaacaaggcc

SEQ ID NO: 212190 - RNA, 20 nt, Homo sapiens
ggguuuggggccagggggcu

SEQ ID NO: 212191 - RNA, 18 nt, Homo sapiens
cugucccauuucccagag

SEQ ID NO: 212192 - RNA, 18 nt, Homo sapiens
guccagcucagaaagcgg

SEQ ID NO: 212193 - RNA, 17 nt, Homo sapiens
caccagcuagccucacc

SEQ ID NO: 212194 - RNA, 17 nt, Homo sapiens
aaacucccuggcaaugu

SEQ ID NO: 212195 - RNA, 17 nt, Homo sapiens
agcauguacccacagug

SEQ ID NO: 212196 - RNA, 17 nt, Homo sapiens
guggcuuugcucaggga

SEQ ID NO: 212197 - RNA, 18 nt, Homo sapiens
aggaagcuacagaauccc

SEQ ID NO: 212198 - RNA, 21 nt, Homo sapiens
cgcagggcgguccaccgcuaa

SEQ ID NO: 212199 - RNA, 21 nt, Homo sapiens
ccccacgcgcugagcccacag

SEQ ID NO: 212200 - RNA, 18 nt, Homo sapiens
ucugaggcuguggggcug

SEQ ID NO: 212201 - RNA, 20 nt, Homo sapiens
uuaagguuagggucucaggg

SEQ ID NO: 212202 - RNA, 18 nt, Homo sapiens
ucacugagacaagugcaa

SEQ ID NO: 212203 - RNA, 20 nt, Homo sapiens
gucugggagacagaggaaca

SEQ ID NO: 212204 - RNA, 19 nt, Homo sapiens
ccagucccccaugcaagcc

SEQ ID NO: 212205 - RNA, 17 nt, Homo sapiens
aauccugggaaaacugg

SEQ ID NO: 212206 - RNA, 19 nt, Homo sapiens
guggaacuagggucucagg

SEQ ID NO: 212207 - RNA, 19 nt, Homo sapiens
gcaaggcucugaucugagg

SEQ ID NO: 212208 - RNA, 18 nt, Homo sapiens
cccuccgggaagcccacc

SEQ ID NO: 212209 - RNA, 18 nt, Homo sapiens
cugcugaguccugcagug

SEQ ID NO: 212210 - RNA, 17 nt, Homo sapiens
ugcagucuccucccuca

SEQ ID NO: 212211 - RNA, 18 nt, Homo sapiens
ccaucuuccuucagccuc

SEQ ID NO: 212212 - RNA, 22 nt, Homo sapiens
cucagcuacagacaucagugac

SEQ ID NO: 212213 - RNA, 22 nt, Homo sapiens
uagcuccuuuccacagacaggu

SEQ ID NO: 212214 - RNA, 21 nt, Homo sapiens
uggguacuuccugaugcuuuu

SEQ ID NO: 212215 - RNA, 21 nt, Homo sapiens
uuguugcuuuuuggugccuau

SEQ ID NO: 212216 - RNA, 22 nt, Homo sapiens
gcaugggaacaaaaaggcaacu

SEQ ID NO: 212217 - RNA, 22 nt, Homo sapiens
uaguccauuuugaguuaacucu

SEQ ID NO: 212218 - RNA, 22 nt, Homo sapiens
augguccugcugaaucccaaca

SEQ ID NO: 212219 - RNA, 17 nt, Homo sapiens
aaaguacguccaucuuc

SEQ ID NO: 212220 - RNA, 21 nt, Homo sapiens
acucuucagacucuauucaga

SEQ ID NO: 212221 - RNA, 22 nt, Homo sapiens
gcuccauguucccgucuccuug

SEQ ID NO: 212222 - RNA, 20 nt, Homo sapiens
cgccucucagcccagcuuuu

SEQ ID NO: 212223 - RNA, 18 nt, Homo sapiens
cuccgcucacuccagccu

SEQ ID NO: 212224 - RNA, 22 nt, Homo sapiens
accuucuaguuuucagagucgc

SEQ ID NO: 212225 - RNA, 20 nt, Homo sapiens
aggcaucuugcagagucuuu

SEQ ID NO: 212226 - RNA, 21 nt, Homo sapiens
augucccacccccacuccugu

SEQ ID NO: 212227 - RNA, 21 nt, Homo sapiens
acaggaguggggggugggacg

SEQ ID NO: 212228 - RNA, 18 nt, Homo sapiens
uucuacuuuacuucuccu

SEQ ID NO: 212229 - RNA, 22 nt, Homo sapiens
ccucugugugagcucuggccau

SEQ ID NO: 212230 - RNA, 21 nt, Homo sapiens
auccacuucugccuguccugc

SEQ ID NO: 212231 - RNA, 22 nt, Homo sapiens
uuguccacuucuuccugcccug

SEQ ID NO: 212232 - RNA, 22 nt, Homo sapiens
ggcagggcaggcagaaguggac

SEQ ID NO: 212233 - RNA, 21 nt, Homo sapiens
aaccuuuguacccugagccca

SEQ ID NO: 212234 - RNA, 21 nt, Homo sapiens
acugucuuuucuaagccugug

SEQ ID NO: 212235 - RNA, 22 nt, Homo sapiens
augccuccaagguaucagucac

SEQ ID NO: 212236 - RNA, 22 nt, Homo sapiens
caagccagcaagccccacgaca

SEQ ID NO: 212237 - RNA, 17 nt, Homo sapiens
uacaaucuccucccugu

SEQ ID NO: 212238 - RNA, 17 nt, Homo sapiens
ccucccucuuguccggc

SEQ ID NO: 212239 - RNA, 17 nt, Homo sapiens
aaaacccacgccuccaa

SEQ ID NO: 212240 - RNA, 18 nt, Homo sapiens
cgccucuuccaacucgag

SEQ ID NO: 212241 - RNA, 21 nt, Homo sapiens
uggauuguuucuuuugccgug

SEQ ID NO: 212242 - RNA, 22 nt, Homo sapiens
ugcacggcaaaagaaacaaucu

SEQ ID NO: 212243 - RNA, 22 nt, Homo sapiens
acccaugucacugccagcccug

SEQ ID NO: 212244 - RNA, 22 nt, Homo sapiens
gccaagggaauggcagggaaau

SEQ ID NO: 212245 - RNA, 17 nt, Homo sapiens
aaacaacagcccccacc

SEQ ID NO: 212246 - RNA, 20 nt, Homo sapiens
uaccccuagaccaaggagcc

SEQ ID NO: 212247 - RNA, 22 nt, Homo sapiens
ugccucgcgcagccccgggacg

SEQ ID NO: 212248 - RNA, 22 nt, Homo sapiens
ucaccacuucuccaaaucccca

SEQ ID NO: 212249 - RNA, 17 nt, Homo sapiens
uguccucagcucuacca

SEQ ID NO: 212250 - RNA, 23 nt, Homo sapiens
aucacuuaaggccaagaauucaa

SEQ ID NO: 212251 - RNA, 20 nt, Homo sapiens
aaccgcuacagaccaagcuc

SEQ ID NO: 212252 - RNA, 20 nt, Homo sapiens
uggugccgugacucggaucc

SEQ ID NO: 212253 - RNA, 17 nt, Homo sapiens
aaaaacacacacacccu

SEQ ID NO: 212254 - RNA, 17 nt, Homo sapiens
aaaaggaagccaccagg

SEQ ID NO: 212255 - RNA, 22 nt, Homo sapiens
uacgccagucaauaccuuguga

SEQ ID NO: 212256 - RNA, 19 nt, Homo sapiens
uucuuccacaccuaccucu

SEQ ID NO: 212257 - RNA, 22 nt, Homo sapiens
cuccaccuccuccgccuccugg

SEQ ID NO: 212258 - RNA, 22 nt, Homo sapiens
aagguaaauucacaaccacuau

SEQ ID NO: 212259 - RNA, 23 nt, Homo sapiens
gccuagcccuacuagucucaauc

SEQ ID NO: 212260 - RNA, 23 nt, Homo sapiens
uucccaagccacccuccguguca

SEQ ID NO: 212261 - RNA, 17 nt, Homo sapiens
ggccccaccccagucuc

SEQ ID NO: 212262 - RNA, 21 nt, Homo sapiens
uauugcaucuauccaaaccuu

SEQ ID NO: 212263 - RNA, 22 nt, Homo sapiens
uccccuggucagacuacuugag

SEQ ID NO: 212264 - RNA, 18 nt, Homo sapiens
ccccgccggcccgcaccc

SEQ ID NO: 212265 - RNA, 22 nt, Homo sapiens
aagcccauaacuaccgccgcca

SEQ ID NO: 212266 - RNA, 18 nt, Homo sapiens
aucucauccuucugcucu

SEQ ID NO: 212267 - RNA, 22 nt, Homo sapiens
uccgagcgacccuagagggagc

SEQ ID NO: 212268 - RNA, 21 nt, Homo sapiens
ucucggcuuccacguuugcca

SEQ ID NO: 212269 - RNA, 22 nt, Homo sapiens
uuaaaccucuacuaaguuccca

SEQ ID NO: 212270 - RNA, 18 nt, Homo sapiens
aaaacaacaccccccacc

SEQ ID NO: 212271 - RNA, 22 nt, Homo sapiens
uacuuguaacggagagcacuag

SEQ ID NO: 212272 - RNA, 22 nt, Homo sapiens
uuagccucaugaccagccacaa

SEQ ID NO: 212273 - RNA, 21 nt, Homo sapiens
ugugucugaucaugagacuaa

SEQ ID NO: 212274 - RNA, 22 nt, Homo sapiens
auaaugaaugcuuggucccuug

SEQ ID NO: 212275 - RNA, 22 nt, Homo sapiens
gccugucccuaaauccuuccug

SEQ ID NO: 212276 - RNA, 22 nt, Homo sapiens
gaaucacaaauguccuuaauag

SEQ ID NO: 212277 - RNA, 22 nt, Homo sapiens
aucaaucacaaauguccuuaau

SEQ ID NO: 212278 - RNA, 17 nt, Homo sapiens
cuccucagcucagccuc

SEQ ID NO: 212279 - RNA, 22 nt, Homo sapiens
cugcuccgagcacggccgcgcg

SEQ ID NO: 212280 - RNA, 21 nt, Homo sapiens
uaaaguaacuuccacuuggcu

SEQ ID NO: 212281 - RNA, 17 nt, Homo sapiens
aaccaccagcccacucc

SEQ ID NO: 212282 - RNA, 22 nt, Homo sapiens
gagccccacugagaaauagaaa

SEQ ID NO: 212283 - RNA, 22 nt, Homo sapiens
cauuuccauagcccacuggguu

SEQ ID NO: 212284 - RNA, 17 nt, Homo sapiens
caacaacagaccacccc

SEQ ID NO: 212285 - RNA, 20 nt, Homo sapiens
uggggcuucucccgccuuuu

SEQ ID NO: 212286 - RNA, 20 nt, Homo sapiens
uuaggguaccgcggccguua

SEQ ID NO: 212287 - RNA, 17 nt, Homo sapiens
ugccagccucgcccagc

SEQ ID NO: 212288 - RNA, 19 nt, Homo sapiens
cugcccuucagccagcucu

SEQ ID NO: 212289 - RNA, 18 nt, Homo sapiens
cgccggagcccgcccccu

SEQ ID NO: 212290 - RNA, 21 nt, Homo sapiens
cguccugcaucacuagcccca

SEQ ID NO: 212291 - RNA, 22 nt, Homo sapiens
uaugcccaaaucucuuaccaga

SEQ ID NO: 212292 - RNA, 22 nt, Homo sapiens
uuuggucacaccaguccacauu

SEQ ID NO: 212293 - RNA, 17 nt, Homo sapiens
ggcgcgcgcccagcccc

SEQ ID NO: 212294 - RNA, 21 nt, Homo sapiens
acagagauggaaaggccuucu

SEQ ID NO: 212295 - RNA, 22 nt, Homo sapiens
ccucuggucagccacagucugg

SEQ ID NO: 212296 - RNA, 21 nt, Homo sapiens
agcaaaaagccuguuuacauu

SEQ ID NO: 212297 - RNA, 22 nt, Homo sapiens
cccucucagcuucaguuuccuc

SEQ ID NO: 212298 - RNA, 17 nt, Homo sapiens
gcccagccgucccggag

SEQ ID NO: 212299 - RNA, 22 nt, Homo sapiens
cagcacuugcccugccagccca

SEQ ID NO: 212300 - RNA, 17 nt, Homo sapiens
ucccuccucucagucuu

SEQ ID NO: 212301 - RNA, 17 nt, Homo sapiens
aagaaacuacuaccuca

SEQ ID NO: 212302 - RNA, 21 nt, Homo sapiens
ugauucauccgaggucacaua

SEQ ID NO: 212303 - RNA, 22 nt, Homo sapiens
cuucagcaccaucaucaucagc

SEQ ID NO: 212304 - RNA, 22 nt, Homo sapiens
uaaauucuauuuccugcuuaaa

SEQ ID NO: 212305 - RNA, 22 nt, Homo sapiens
cauguucaucucuauugucaca

SEQ ID NO: 212306 - RNA, 18 nt, Homo sapiens
uccgucccagcccagccu

SEQ ID NO: 212307 - RNA, 20 nt, Homo sapiens
uugccucagaccacccauuu

SEQ ID NO: 212308 - RNA, 20 nt, Homo sapiens
cccagcccagcccaacccag

SEQ ID NO: 212309 - RNA, 17 nt, Homo sapiens
cgcgcgcccagccccgc

SEQ ID NO: 212310 - RNA, 22 nt, Homo sapiens
aaaaccuucuauauccuuuagu

SEQ ID NO: 212311 - RNA, 22 nt, Homo sapiens
aaccauacauccuacucccuca

SEQ ID NO: 212312 - RNA, 22 nt, Homo sapiens
agggcaaaugcaacaguucuuc

SEQ ID NO: 212313 - RNA, 22 nt, Homo sapiens
ugggcgauacagugaggcccug

SEQ ID NO: 212314 - RNA, 22 nt, Homo sapiens
augggccuccagccgucagucu

SEQ ID NO: 212315 - RNA, 18 nt, Homo sapiens
uuccccaauccugccugu

SEQ ID NO: 212316 - RNA, 22 nt, Homo sapiens
gggcugccgggaguccaguccu

SEQ ID NO: 212317 - RNA, 17 nt, Homo sapiens
gccccgacccuucuccc

SEQ ID NO: 212318 - RNA, 25 nt, Homo sapiens
cucagcugugaguuucaucauauuu

SEQ ID NO: 212319 - RNA, 26 nt, Homo sapiens
ucucagcacaguuaucaucccugagc

SEQ ID NO: 212320 - RNA, 18 nt, Homo sapiens
cagcccugcgcacugcug

SEQ ID NO: 212321 - RNA, 22 nt, Homo sapiens
uuccugcguguuuucuguccaa

SEQ ID NO: 212322 - RNA, 20 nt, Homo sapiens
uuggacagaaaacacgcagg

SEQ ID NO: 212323 - RNA, 22 nt, Homo sapiens
accugcguguuuucuguccaaa

SEQ ID NO: 212324 - RNA, 20 nt, Homo sapiens
uuggacagaaaacacgcagg

SEQ ID NO: 212325 - RNA, 22 nt, Homo sapiens
cugagcacaggacuuccuuagc

SEQ ID NO: 212326 - RNA, 21 nt, Homo sapiens
accggccuacaggcagaguca

SEQ ID NO: 212327 - RNA, 21 nt, Homo sapiens
acagccgaggcccucucgguc

SEQ ID NO: 212328 - RNA, 22 nt, Homo sapiens
auagcagcauaagccugucuca

SEQ ID NO: 212329 - RNA, 22 nt, Homo sapiens
ugagacagguucaugcugcuau

SEQ ID NO: 212330 - RNA, 20 nt, Homo sapiens
uagcagcaugaaccugucuc

SEQ ID NO: 212331 - RNA, 21 nt, Homo sapiens
gagacaggcuuaugcugcuau

SEQ ID NO: 212332 - RNA, 21 nt, Homo sapiens
aaccagcaugcacaucccccc

SEQ ID NO: 212333 - RNA, 22 nt, Homo sapiens
agcggccagcccugcugucagc

SEQ ID NO: 212334 - RNA, 22 nt, Homo sapiens
acagucaucucuuugcagacca

SEQ ID NO: 212335 - RNA, 22 nt, Homo sapiens
guccagaucauacauauaauga

SEQ ID NO: 212336 - RNA, 21 nt, Homo sapiens
acgggccaucagcaguccaau

SEQ ID NO: 212337 - RNA, 22 nt, Homo sapiens
uucauuggacugcugauggccu

SEQ ID NO: 212338 - RNA, 18 nt, Homo sapiens
cgcucccguccugcuggg

SEQ ID NO: 212339 - RNA, 17 nt, Homo sapiens
ucagaagccuucuccau

SEQ ID NO: 212340 - RNA, 17 nt, Homo sapiens
cgccgggcuccccgggg

SEQ ID NO: 212341 - RNA, 22 nt, Homo sapiens
agcguccggcaaccuccuucca

SEQ ID NO: 212342 - RNA, 17 nt, Homo sapiens
agaccccuccuccaucc

SEQ ID NO: 212343 - RNA, 17 nt, Homo sapiens
gucccagccagguccac

SEQ ID NO: 212344 - RNA, 21 nt, Homo sapiens
augugguagauauaugcacga

SEQ ID NO: 212345 - RNA, 21 nt, Homo sapiens
aucgugcauauaucuaccaca

SEQ ID NO: 212346 - RNA, 22 nt, Homo sapiens
cagcuaagcucagcucggcuca

SEQ ID NO: 212347 - RNA, 22 nt, Homo sapiens
ucagcccagcucauccaagcuc

SEQ ID NO: 212348 - RNA, 22 nt, Homo sapiens
gcccagcucagcccaguucagc

SEQ ID NO: 212349 - RNA, 21 nt, Homo sapiens
uaaaccuacaggcaggacuaa

SEQ ID NO: 212350 - RNA, 22 nt, Homo sapiens
cuagagcagcgagagggcggca

SEQ ID NO: 212351 - RNA, 23 nt, Homo sapiens
uccgccacacccacgcugcccuc

SEQ ID NO: 212352 - RNA, 22 nt, Homo sapiens
ugcauaugccuggcuagcuccu

SEQ ID NO: 212353 - RNA, 20 nt, Homo sapiens
gaggagcuagccaggcauau

SEQ ID NO: 212354 - RNA, 19 nt, Homo sapiens
ccccgggccggucgcgccg

SEQ ID NO: 212355 - RNA, 21 nt, Homo sapiens
uugcggguucugacuucaaga

SEQ ID NO: 212356 - RNA, 22 nt, Homo sapiens
cuaaaggcuuugaacacgaguu

SEQ ID NO: 212357 - RNA, 22 nt, Homo sapiens
ucacuugaaucugcaguuagua

SEQ ID NO: 212358 - RNA, 23 nt, Homo sapiens
cggccggcugagcgguguccagg

SEQ ID NO: 212359 - RNA, 21 nt, Homo sapiens
acuuguccaccgcagccgagu

SEQ ID NO: 212360 - RNA, 20 nt, Homo sapiens
gcaaagcaaggugagaguga

SEQ ID NO: 212361 - RNA, 22 nt, Homo sapiens
ucaaucucagccuacuuagcaa

SEQ ID NO: 212362 - RNA, 22 nt, Homo sapiens
gugggccaggaaacagggggug

SEQ ID NO: 212363 - RNA, 23 nt, Homo sapiens
cccaccagcugcucccuggccca

SEQ ID NO: 212364 - RNA, 24 nt, Homo sapiens
ugaggcaaaaguauggcaugggca

SEQ ID NO: 212365 - RNA, 22 nt, Homo sapiens
agccaccaggggacgaugccau

SEQ ID NO: 212366 - RNA, 22 nt, Homo sapiens
uuagcauuuauggucauguguc

SEQ ID NO: 212367 - RNA, 23 nt, Homo sapiens
cuucugucucuuuucucucucca

SEQ ID NO: 212368 - RNA, 22 nt, Homo sapiens
aaccaggcaagaacuacugucu

SEQ ID NO: 212369 - RNA, 19 nt, Homo sapiens
acaauauuucuugccuggu

SEQ ID NO: 212370 - RNA, 21 nt, Homo sapiens
cugggaagggagagggacaau

SEQ ID NO: 212371 - RNA, 22 nt, Homo sapiens
ucccucagcuccucuucccagu

SEQ ID NO: 212372 - RNA, 23 nt, Homo sapiens
uuccucagcacagcaccaucuuc

SEQ ID NO: 212373 - RNA, 20 nt, Homo sapiens
cucccauuugcagucccaca

SEQ ID NO: 212374 - RNA, 21 nt, Homo sapiens
uggggagaggcaggccucaga

SEQ ID NO: 212375 - RNA, 24 nt, Homo sapiens
cucugagagcccaccccucgccca

SEQ ID NO: 212376 - RNA, 21 nt, Homo sapiens
augucaggccucauucuaccu

SEQ ID NO: 212377 - RNA, 19 nt, Homo sapiens
aagguagaaagaggccuga

SEQ ID NO: 212378 - RNA, 20 nt, Homo sapiens
gcccgaccucacccaccccg

SEQ ID NO: 212379 - RNA, 22 nt, Homo sapiens
ugaggggauggguuaacagaac

SEQ ID NO: 212380 - RNA, 22 nt, Homo sapiens
uaguucuauuaaccaguccccu

SEQ ID NO: 212381 - RNA, 23 nt, Homo sapiens
ucuccaagcaacccuuaacucca

SEQ ID NO: 212382 - RNA, 22 nt, Homo sapiens
gguguuaagccuugcucagaga

SEQ ID NO: 212383 - RNA, 22 nt, Homo sapiens
ccagaugccuccagaucccaca

SEQ ID NO: 212384 - RNA, 21 nt, Homo sapiens
ccccggggaccugacgagggu

SEQ ID NO: 212385 - RNA, 22 nt, Homo sapiens
cgacccucugccauccccggug

SEQ ID NO: 212386 - RNA, 23 nt, Homo sapiens
acaggccuccugcccucagccca

SEQ ID NO: 212387 - RNA, 23 nt, Homo sapiens
augccucagaccacuuccacauu

SEQ ID NO: 212388 - RNA, 23 nt, Homo sapiens
auuccuccaggauccacacucac

SEQ ID NO: 212389 - RNA, 22 nt, Homo sapiens
cguugccaugucuaagaagaaa

SEQ ID NO: 212390 - RNA, 22 nt, Homo sapiens
guuuucuucuuagacauggcag

SEQ ID NO: 212391 - RNA, 22 nt, Homo sapiens
agcugccaugucuaagaagaaa

SEQ ID NO: 212392 - RNA, 19 nt, Homo sapiens
uucuucuuagacauggcaa

SEQ ID NO: 212393 - RNA, 23 nt, Homo sapiens
cuccauuuuccaccagagcugca

SEQ ID NO: 212394 - RNA, 22 nt, Homo sapiens
uggacuagcucuguggauccug

SEQ ID NO: 212395 - RNA, 22 nt, Homo sapiens
gucaggauccacagagcuaguu

SEQ ID NO: 212396 - RNA, 22 nt, Homo sapiens
auuuagccaauugucuaucuuu

SEQ ID NO: 212397 - RNA, 22 nt, Homo sapiens
cuaaagauggacaauuggcuaa

SEQ ID NO: 212398 - RNA, 22 nt, Homo sapiens
auuuagccaauuguccaucuuu

SEQ ID NO: 212399 - RNA, 24 nt, Homo sapiens
acugcacguccauggagcucagcu

SEQ ID NO: 212400 - RNA, 22 nt, Homo sapiens
gacggggcucacagaccggaag

SEQ ID NO: 212401 - RNA, 22 nt, Homo sapiens
aacuugcggagugggcacccca

SEQ ID NO: 212402 - RNA, 26 nt, Homo sapiens
ggcgggggcuacgcgccgcggccgag

SEQ ID NO: 212403 - RNA, 23 nt, Homo sapiens
gcucgcgcucacgcgucccccag

SEQ ID NO: 212404 - RNA, 21 nt, Homo sapiens
aaauacaugucagauuguaug

SEQ ID NO: 212405 - RNA, 21 nt, Homo sapiens
ggcauacaaucugacauguau

SEQ ID NO: 212406 - RNA, 23 nt, Homo sapiens
gggaauuacaaucugacaugcaa

SEQ ID NO: 212407 - RNA, 21 nt, Homo sapiens
cuguggggacagaaggaggga

SEQ ID NO: 212408 - RNA, 22 nt, Homo sapiens
gguucuccuucugcuccccagu

SEQ ID NO: 212409 - RNA, 23 nt, Homo sapiens
cuggaaaaacaaaaaggauuuuc

SEQ ID NO: 212410 - RNA, 23 nt, Homo sapiens
gacaaauccuuuuuuuuuucccu

SEQ ID NO: 212411 - RNA, 22 nt, Homo sapiens
ccuccuccacuucccggacaca

SEQ ID NO: 212412 - RNA, 22 nt, Homo sapiens
aagcgaccaugauguaacuuca

SEQ ID NO: 212413 - RNA, 22 nt, Homo sapiens
ugaaguuacaucauggucgcuu

SEQ ID NO: 212414 - RNA, 21 nt, Homo sapiens
agaccaaagacuaugcacuaa

SEQ ID NO: 212415 - RNA, 22 nt, Homo sapiens
agauuagcgcacagucuucggu

SEQ ID NO: 212416 - RNA, 21 nt, Homo sapiens
ugccucuguccagcuguguaa

SEQ ID NO: 212417 - RNA, 22 nt, Homo sapiens
uccaguccggcuccugccugga

SEQ ID NO: 212418 - RNA, 21 nt, Homo sapiens
agccgcgcgucccgagcccag

SEQ ID NO: 212419 - RNA, 22 nt, Homo sapiens
ccugcuggucaaucacagcccc

SEQ ID NO: 212420 - RNA, 22 nt, Homo sapiens
aagagccaguggugaaacagug

SEQ ID NO: 212421 - RNA, 21 nt, Homo sapiens
ucacugucucaccacuggcuc

SEQ ID NO: 212422 - RNA, 22 nt, Homo sapiens
aguaguucuuuggucucacaga

SEQ ID NO: 212423 - RNA, 22 nt, Homo sapiens
uggcugaaagaccaaagaacaa

SEQ ID NO: 212424 - RNA, 22 nt, Homo sapiens
ucauaagucugaacaauaccuu

SEQ ID NO: 212425 - RNA, 22 nt, Homo sapiens
agcaaagaaucucuaucacaga

SEQ ID NO: 212426 - RNA, 21 nt, Homo sapiens
uaacaacucuuacaauucaga

SEQ ID NO: 212427 - RNA, 23 nt, Homo sapiens
acaucuaagacugcaagaguucu

SEQ ID NO: 212428 - RNA, 22 nt, Homo sapiens
agauacagccugcauucccguu

SEQ ID NO: 212429 - RNA, 23 nt, Homo sapiens
agaccaggcuccaggaacucaga

SEQ ID NO: 212430 - RNA, 23 nt, Homo sapiens
aucgggcgagcacuggaucucca

SEQ ID NO: 212431 - RNA, 22 nt, Homo sapiens
acgucuccaccgacuugcaaca

SEQ ID NO: 212432 - RNA, 22 nt, Homo sapiens
uauguugcaagucaguagagag

SEQ ID NO: 212433 - RNA, 22 nt, Homo sapiens
cuagccagggcaggaagggaga

SEQ ID NO: 212434 - RNA, 26 nt, Homo sapiens
aaccuugccccacuccaagcccuggg

SEQ ID NO: 212435 - RNA, 23 nt, Homo sapiens
aacaccagaaagcccagcagaua

SEQ ID NO: 212436 - RNA, 21 nt, Homo sapiens
gccugcccccuccaacagcca

SEQ ID NO: 212437 - RNA, 22 nt, Homo sapiens
uuugggugcgggaggagggcug

SEQ ID NO: 212438 - RNA, 22 nt, Homo sapiens
cccagguccucugcugccccua

SEQ ID NO: 212439 - RNA, 22 nt, Homo sapiens
ggcccccaccaugucuccucaa

SEQ ID NO: 212440 - RNA, 21 nt, Homo sapiens
cagaggccucagcugggcugc

SEQ ID NO: 212441 - RNA, 22 nt, Homo sapiens
uucagcccagccucgccugcuc

SEQ ID NO: 212442 - RNA, 23 nt, Homo sapiens
augcacucucaguccguggcugg

SEQ ID NO: 212443 - RNA, 23 nt, Homo sapiens
ccgcagcucauggccuggaggac

SEQ ID NO: 212444 - RNA, 22 nt, Homo sapiens
aucugauacccacacugccuga

SEQ ID NO: 212445 - RNA, 23 nt, Homo sapiens
aaauacugugaauuccacucuca

SEQ ID NO: 212446 - RNA, 23 nt, Homo sapiens
ugugacagugaaauucacaguau

SEQ ID NO: 212447 - RNA, 21 nt, Homo sapiens
agguguuauccuguccauuug

SEQ ID NO: 212448 - RNA, 22 nt, Homo sapiens
gcaaauggauaggauaacaccu

SEQ ID NO: 212449 - RNA, 22 nt, Homo sapiens
gaaggaggcagcggugagauca

SEQ ID NO: 212450 - RNA, 22 nt, Homo sapiens
ccugcucgcccacugccuccug

SEQ ID NO: 212451 - RNA, 22 nt, Homo sapiens
agaugacaguauccgucuugca

SEQ ID NO: 212452 - RNA, 24 nt, Homo sapiens
accaaggggcaggagucacugaca

SEQ ID NO: 212453 - RNA, 22 nt, Homo sapiens
cacgucagugacugcgcccccu

SEQ ID NO: 212454 - RNA, 23 nt, Homo sapiens
uggggucuuccucuacauuuuga

SEQ ID NO: 212455 - RNA, 22 nt, Homo sapiens
ggagaagauugcagaguaaauu

SEQ ID NO: 212456 - RNA, 22 nt, Homo sapiens
ggaacuuacucugcaaucuucu

SEQ ID NO: 212457 - RNA, 26 nt, Homo sapiens
cacuggggugaggagucaguccugug

SEQ ID NO: 212458 - RNA, 22 nt, Homo sapiens
acacacuguccucauccccaga

SEQ ID NO: 212459 - RNA, 20 nt, Homo sapiens
acaccacacccaucacccau

SEQ ID NO: 212460 - RNA, 22 nt, Homo sapiens
aagggguaggugugguggccaa

SEQ ID NO: 212461 - RNA, 22 nt, Homo sapiens
guggcaauacaauacaacuaca

SEQ ID NO: 212462 - RNA, 23 nt, Homo sapiens
acuauauuuguacuguauugcua

SEQ ID NO: 212463 - RNA, 22 nt, Homo sapiens
uagacacuagauaugugacuga

SEQ ID NO: 212464 - RNA, 22 nt, Homo sapiens
aaucacucacaugccuaguguc

SEQ ID NO: 212465 - RNA, 22 nt, Homo sapiens
acagcaauuaccaagugauuga

SEQ ID NO: 212466 - RNA, 25 nt, Homo sapiens
aagcagcgcccacuuccuccccgcu

SEQ ID NO: 212467 - RNA, 22 nt, Homo sapiens
agaaccucggcuggggcgggcu

SEQ ID NO: 212468 - RNA, 23 nt, Homo sapiens
ccagaacccgcccgcgccggggc

SEQ ID NO: 212469 - RNA, 22 nt, Homo sapiens
aucagagagaugccgccuugcu

SEQ ID NO: 212470 - RNA, 21 nt, Homo sapiens
aaggagcaaggcggcaucucu

SEQ ID NO: 212471 - RNA, 23 nt, Homo sapiens
gcuacagagcaccuccucuucaa

SEQ ID NO: 212472 - RNA, 22 nt, Homo sapiens
uuggagagcaagucacuguugu

SEQ ID NO: 212473 - RNA, 18 nt, Homo sapiens
aaccaccugcccucaccc

SEQ ID NO: 212474 - RNA, 18 nt, Homo sapiens
aucaagccagaagacacg

SEQ ID NO: 212475 - RNA, 23 nt, Homo sapiens
cucaugucuucuggccugaugca

SEQ ID NO: 212476 - RNA, 21 nt, Homo sapiens
auacaguacaggucucucauu

SEQ ID NO: 212477 - RNA, 22 nt, Homo sapiens
gaaaugagagaccuguacugga

SEQ ID NO: 212478 - RNA, 22 nt, Homo sapiens
uucucccacugucuggauccca

SEQ ID NO: 212479 - RNA, 22 nt, Homo sapiens
ugggagccugguagugggagaa

SEQ ID NO: 212480 - RNA, 22 nt, Homo sapiens
caacucugaccaccuagguugg

SEQ ID NO: 212481 - RNA, 22 nt, Homo sapiens
aucaaccuaaggggucagaguu

SEQ ID NO: 212482 - RNA, 23 nt, Homo sapiens
auuggcugcaguuaagguggcac

SEQ ID NO: 212483 - RNA, 22 nt, Homo sapiens
ccaccuuaacugcagccaacuu

SEQ ID NO: 212484 - RNA, 22 nt, Homo sapiens
ucuccauguuuccuucccccuu

SEQ ID NO: 212485 - RNA, 22 nt, Homo sapiens
agaagggggaaggaaacaugga

SEQ ID NO: 212486 - RNA, 21 nt, Homo sapiens
aggccacagccacccaugugu

SEQ ID NO: 212487 - RNA, 22 nt, Homo sapiens
acacauggguggcuguggccua

SEQ ID NO: 212488 - RNA, 21 nt, Homo sapiens
ugcuugguuucagguacagcu

SEQ ID NO: 212489 - RNA, 22 nt, Homo sapiens
ccugcauauuauagauuuguga

SEQ ID NO: 212490 - RNA, 21 nt, Homo sapiens
auacuugguacaacuuaagca

SEQ ID NO: 212491 - RNA, 22 nt, Homo sapiens
aaguuauaccaaauaugccagg

SEQ ID NO: 212492 - RNA, 22 nt, Homo sapiens
ccaccgucaccuggagcccuca

SEQ ID NO: 212493 - RNA, 22 nt, Homo sapiens
cugcagggaggugcuggcaggu

SEQ ID NO: 212494 - RNA, 23 nt, Homo sapiens
caaccuggcacagcccuccugcc

SEQ ID NO: 212495 - RNA, 22 nt, Homo sapiens
uuuggggaggagccagagaggg

SEQ ID NO: 212496 - RNA, 24 nt, Homo sapiens
ugcucuuaucucauggcuccccca

SEQ ID NO: 212497 - RNA, 21 nt, Homo sapiens
acuagcugaaccagaagguac

SEQ ID NO: 212498 - RNA, 23 nt, Homo sapiens
cgaagcucacuccugguucaguu

SEQ ID NO: 212499 - RNA, 22 nt, Homo sapiens
cccgacacugacgccuucccca

SEQ ID NO: 212500 - RNA, 21 nt, Homo sapiens
ggugggaaggcugcagggucu

SEQ ID NO: 212501 - RNA, 22 nt, Homo sapiens
ugcggccagagggaaccugggu

SEQ ID NO: 212502 - RNA, 23 nt, Homo sapiens
ccacuccaggcuccucuggcccu

SEQ ID NO: 212503 - RNA, 22 nt, Homo sapiens
gaaucugccagcuucccacuau

SEQ ID NO: 212504 - RNA, 21 nt, Homo sapiens
ccacuguggaagcuggcagau

SEQ ID NO: 212505 - RNA, 25 nt, Homo sapiens
cuggggcaggagggaggucagcaug

SEQ ID NO: 212506 - RNA, 23 nt, Homo sapiens
ugcuugcugccucuccccuccca

SEQ ID NO: 212507 - RNA, 22 nt, Homo sapiens
uagcuucccaacagauaaauga

SEQ ID NO: 212508 - RNA, 23 nt, Homo sapiens
uggcauggaaugggcuccgccag

SEQ ID NO: 212509 - RNA, 22 nt, Homo sapiens
aguguugggggccacuugugug

SEQ ID NO: 212510 - RNA, 22 nt, Homo sapiens
cacacucauguggcccccagca

SEQ ID NO: 212511 - RNA, 21 nt, Homo sapiens
cagaacaggacaggucagggc

SEQ ID NO: 212512 - RNA, 23 nt, Homo sapiens
agcuuccugcucccugcucuaca

SEQ ID NO: 212513 - RNA, 22 nt, Homo sapiens
aucccaaugcuagaccuggugg

SEQ ID NO: 212514 - RNA, 22 nt, Homo sapiens
caccgggucuagcauugggauu

SEQ ID NO: 212515 - RNA, 22 nt, Homo sapiens
cgcccugaccgcagcccgcagc

SEQ ID NO: 212516 - RNA, 21 nt, Homo sapiens
augucuaauuugagcaccuuu

SEQ ID NO: 212517 - RNA, 22 nt, Homo sapiens
uaccgaagguguucaaauuagg

SEQ ID NO: 212518 - RNA, 19 nt, Homo sapiens
cagcccagauaaccugccu

SEQ ID NO: 212519 - RNA, 20 nt, Homo sapiens
cacugucagcauccucgcau

SEQ ID NO: 212520 - RNA, 22 nt, Homo sapiens
uccuccaggcgcuccaguuuca

SEQ ID NO: 212521 - RNA, 22 nt, Homo sapiens
augaaacugaaaacgcgcuggu

SEQ ID NO: 212522 - RNA, 25 nt, Homo sapiens
agggccccuccgcuccuccucccuu

SEQ ID NO: 212523 - RNA, 22 nt, Homo sapiens
gcagggacggauccucucgggc

SEQ ID NO: 212524 - RNA, 22 nt, Homo sapiens
ccugcccgagaggaucaguccu

SEQ ID NO: 212525 - RNA, 23 nt, Homo sapiens
agccgaccccuccggacagcccg

SEQ ID NO: 212526 - RNA, 23 nt, Homo sapiens
cugcaggcaaaggagaauacaga

SEQ ID NO: 212527 - RNA, 23 nt, Homo sapiens
ucuguaaauaucccuuugccuga

SEQ ID NO: 212528 - RNA, 21 nt, Homo sapiens
cuggaccagaaaagacagaaa

SEQ ID NO: 212529 - RNA, 23 nt, Homo sapiens
augccuccugucccauccggcca

SEQ ID NO: 212530 - RNA, 23 nt, Homo sapiens
cauagcgaagucuagucuuuaga

SEQ ID NO: 212531 - RNA, 23 nt, Homo sapiens
gaccgugagacgucgccgggcca

SEQ ID NO: 212532 - RNA, 23 nt, Homo sapiens
cgccgucccgggagccccacuca

SEQ ID NO: 212533 - RNA, 21 nt, Homo sapiens
ucggcccgcaggagcaccgcu

SEQ ID NO: 212534 - RNA, 23 nt, Homo sapiens
ucugcagguucuccugggaccgg

SEQ ID NO: 212535 - RNA, 22 nt, Homo sapiens
cugggaggaaagcccgggccuu

SEQ ID NO: 212536 - RNA, 22 nt, Homo sapiens
cuaagaccaagccuccuucccu

SEQ ID NO: 212537 - RNA, 21 nt, Homo sapiens
agcaaauccuccccaaaccuc

SEQ ID NO: 212538 - RNA, 20 nt, Homo sapiens
cugugggggcaggaggggcg

SEQ ID NO: 212539 - RNA, 22 nt, Homo sapiens
gaugcccuggccuguccccgca

SEQ ID NO: 212540 - RNA, 22 nt, Homo sapiens
cugcgggagggggugggucagg

SEQ ID NO: 212541 - RNA, 22 nt, Homo sapiens
cacucaaccaccuccgcccgag

SEQ ID NO: 212542 - RNA, 24 nt, Homo sapiens
ccuucuagcagcuacggguccucu

SEQ ID NO: 212543 - RNA, 22 nt, Homo sapiens
agcacauccuugagauccacaa

SEQ ID NO: 212544 - RNA, 22 nt, Homo sapiens
acacaaggcuaaagaaagagaa

SEQ ID NO: 212545 - RNA, 22 nt, Homo sapiens
cuguucucuuccuuuggccuug

SEQ ID NO: 212546 - RNA, 23 nt, Homo sapiens
acuccgcuaacccagguccgcau

SEQ ID NO: 212547 - RNA, 22 nt, Homo sapiens
acuuucccuucagagccuggcu

SEQ ID NO: 212548 - RNA, 22 nt, Homo sapiens
aaagccaggcucugaagggaaa

SEQ ID NO: 212549 - RNA, 22 nt, Homo sapiens
auaggaaggcaaccaucucugg

SEQ ID NO: 212550 - RNA, 23 nt, Homo sapiens
agcagagagugagcgccucccug

SEQ ID NO: 212551 - RNA, 22 nt, Homo sapiens
gcgaagccucugugacgucaug

SEQ ID NO: 212552 - RNA, 23 nt, Homo sapiens
acaccgugacgucacagaggccu

SEQ ID NO: 212553 - RNA, 23 nt, Homo sapiens
gaggguggucagcagguggggca

SEQ ID NO: 212554 - RNA, 23 nt, Homo sapiens
cagccccaccggcucccacucac

SEQ ID NO: 212555 - RNA, 21 nt, Homo sapiens
uaauuccaacaucuaguccua

SEQ ID NO: 212556 - RNA, 22 nt, Homo sapiens
gguuuagauugaacaugaauuu

SEQ ID NO: 212557 - RNA, 22 nt, Homo sapiens
cuaacuucauguucaaucuaaa

SEQ ID NO: 212558 - RNA, 21 nt, Homo sapiens
ggacaaagugcgcaugcccuc

SEQ ID NO: 212559 - RNA, 21 nt, Homo sapiens
ggucaggcaugcacaccuugu

SEQ ID NO: 212560 - RNA, 22 nt, Homo sapiens
caccacaaaucuugaucagaag

SEQ ID NO: 212561 - RNA, 21 nt, Homo sapiens
aggcuucugaucaagauuugg

SEQ ID NO: 212562 - RNA, 24 nt, Homo sapiens
cccgcccagcaccagccccugccu

SEQ ID NO: 212563 - RNA, 21 nt, Homo sapiens
agcaggagggcugggcaggcg

SEQ ID NO: 212564 - RNA, 22 nt, Homo sapiens
ccaugggugugaaaggaguuaa

SEQ ID NO: 212565 - RNA, 21 nt, Homo sapiens
agauaacuccuuccacaucca

SEQ ID NO: 212566 - RNA, 22 nt, Homo sapiens
gaacauagcuaucaaucacuca

SEQ ID NO: 212567 - RNA, 21 nt, Homo sapiens
uuccaaaagagcaauugcuau

SEQ ID NO: 212568 - RNA, 21 nt, Homo sapiens
aacaccaacugcucuuucaga

SEQ ID NO: 212569 - RNA, 23 nt, Homo sapiens
ggcggcggccaggagcgcccgcg

SEQ ID NO: 212570 - RNA, 20 nt, Homo sapiens
auucucucuggaucuccugg

SEQ ID NO: 212571 - RNA, 22 nt, Homo sapiens
auccaugggauccagagagaau

SEQ ID NO: 212572 - RNA, 22 nt, Homo sapiens
guaggggagggaggauggcaga

SEQ ID NO: 212573 - RNA, 24 nt, Homo sapiens
cucauaccuucucuccaucccacc

SEQ ID NO: 212574 - RNA, 18 nt, Homo sapiens
agcuacagugucaucuca

SEQ ID NO: 212575 - RNA, 21 nt, Homo sapiens
uaauuguaggucaagucugcu

SEQ ID NO: 212576 - RNA, 22 nt, Homo sapiens
ucugaucaggcaaaguugcagg

SEQ ID NO: 212577 - RNA, 22 nt, Homo sapiens
agucugcaauuuugccugauca

SEQ ID NO: 212578 - RNA, 22 nt, Homo sapiens
gccuuucuaugcuccuguucug

SEQ ID NO: 212579 - RNA, 21 nt, Homo sapiens
uucuggcacauguuaggcaau

SEQ ID NO: 212580 - RNA, 22 nt, Homo sapiens
uuauuaccuacuacauaccaga

SEQ ID NO: 212581 - RNA, 22 nt, Homo sapiens
agugaccgaaacaaaaaauuaa

SEQ ID NO: 212582 - RNA, 23 nt, Homo sapiens
augcaguggaccaggauggcaag

SEQ ID NO: 212583 - RNA, 22 nt, Homo sapiens
agcccuugccauccugguccac

SEQ ID NO: 212584 - RNA, 22 nt, Homo sapiens
uacagcauucuagaugagguau

SEQ ID NO: 212585 - RNA, 22 nt, Homo sapiens
uauauauaucucucaucuagaa

SEQ ID NO: 212586 - RNA, 22 nt, Homo sapiens
ucaacucugcaaaggaagaaga

SEQ ID NO: 212587 - RNA, 22 nt, Homo sapiens
ccucuucuuccuuuacagaauu

SEQ ID NO: 212588 - RNA, 22 nt, Homo sapiens
cugcuuuuacuauucccuccua

SEQ ID NO: 212589 - RNA, 22 nt, Homo sapiens
gcuagggaucaggcucaagggu

SEQ ID NO: 212590 - RNA, 22 nt, Homo sapiens
cucuagcgaggauuccaacauu

SEQ ID NO: 212591 - RNA, 21 nt, Homo sapiens
ccaauauuggaauccccgcua

SEQ ID NO: 212592 - RNA, 22 nt, Homo sapiens
guucuagauaugaagacaauca

SEQ ID NO: 212593 - RNA, 22 nt, Homo sapiens
uugauugucuucauauccagaa

SEQ ID NO: 212594 - RNA, 23 nt, Homo sapiens
gcagacgcgccccaacaccgggg

SEQ ID NO: 212595 - RNA, 21 nt, Homo sapiens
agcccgggagcugggcgcgcc

SEQ ID NO: 212596 - RNA, 20 nt, Homo sapiens
ucagucccagcaucuccuca

SEQ ID NO: 212597 - RNA, 21 nt, Homo sapiens
gcuggcggcgucgccgacucu

SEQ ID NO: 212598 - RNA, 22 nt, Homo sapiens
gcccagaccagagcuggcuuca

SEQ ID NO: 212599 - RNA, 22 nt, Homo sapiens
ggugcauccaguccuggucuca

SEQ ID NO: 212600 - RNA, 24 nt, Homo sapiens
gcgcggggcagugggcggcgcauc

SEQ ID NO: 212601 - RNA, 22 nt, Homo sapiens
gggaugccgccgccacccccgc

SEQ ID NO: 212602 - RNA, 22 nt, Homo sapiens
gccucccuuagcugguccguaa

SEQ ID NO: 212603 - RNA, 21 nt, Homo sapiens
uauauacaccugcuaugugug

SEQ ID NO: 212604 - RNA, 22 nt, Homo sapiens
cauacacauaucagguguauac

SEQ ID NO: 212605 - RNA, 22 nt, Homo sapiens
ugugacaucgcuuuaccauuca

SEQ ID NO: 212606 - RNA, 20 nt, Homo sapiens
aacaugaaugguaaagcgau

SEQ ID NO: 212607 - RNA, 18 nt, Homo sapiens
uuucagucaucauaucca

SEQ ID NO: 212608 - RNA, 18 nt, Homo sapiens
gccagcgagcgcucaccg

SEQ ID NO: 212609 - RNA, 23 nt, Homo sapiens
agccagccaacucacagugcaga

SEQ ID NO: 212610 - RNA, 24 nt, Homo sapiens
ccucugcccuguggagcaggaugu

SEQ ID NO: 212611 - RNA, 22 nt, Homo sapiens
acagucucgugagauagccaga

SEQ ID NO: 212612 - RNA, 22 nt, Homo sapiens
auccagaaguggcuaauaauau

SEQ ID NO: 212613 - RNA, 21 nt, Homo sapiens
ucaauauuauuagccacuucu

SEQ ID NO: 212614 - RNA, 22 nt, Homo sapiens
gugucuauacucugccacuuua

SEQ ID NO: 212615 - RNA, 22 nt, Homo sapiens
guaaagugacagaguauagaca

SEQ ID NO: 212616 - RNA, 21 nt, Homo sapiens
acagagugccacuuacugaga

SEQ ID NO: 212617 - RNA, 21 nt, Homo sapiens
uucaguaaguggcacucuguc

SEQ ID NO: 212618 - RNA, 22 nt, Homo sapiens
acuucgguauacuucgugaguu

SEQ ID NO: 212619 - RNA, 22 nt, Homo sapiens
ccaauucacaaaguauaccgaa

SEQ ID NO: 212620 - RNA, 22 nt, Homo sapiens
uauauaaaugcagcaugccagu

SEQ ID NO: 212621 - RNA, 22 nt, Homo sapiens
gacuggcaugcugcauuuagau

SEQ ID NO: 212622 - RNA, 19 nt, Homo sapiens
guggacagacggacggaug

SEQ ID NO: 212623 - RNA, 21 nt, Homo sapiens
uccuuccuuccucgguccacu

SEQ ID NO: 212624 - RNA, 22 nt, Homo sapiens
ugagccuugguuuucuugugua

SEQ ID NO: 212625 - RNA, 23 nt, Homo sapiens
gcuugaagguuuccauccaugua

SEQ ID NO: 212626 - RNA, 22 nt, Homo sapiens
aacauggucuagaaccuccaua

SEQ ID NO: 212627 - RNA, 21 nt, Homo sapiens
ucaauccacacuauuauguua

SEQ ID NO: 212628 - RNA, 21 nt, Homo sapiens
uuucgagggcaagguuaagca

SEQ ID NO: 212629 - RNA, 21 nt, Homo sapiens
uugcuuaaccuuaccguccaa

SEQ ID NO: 212630 - RNA, 20 nt, Homo sapiens
acuguauugucagguaguga

SEQ ID NO: 212631 - RNA, 21 nt, Homo sapiens
ucacuaccugacaauacagca

SEQ ID NO: 212632 - RNA, 22 nt, Homo sapiens
agcacagacuugcugugauguu

SEQ ID NO: 212633 - RNA, 21 nt, Homo sapiens
aaacaucacugcaagucuuaa

SEQ ID NO: 212634 - RNA, 22 nt, Homo sapiens
uguuaagacuugcagugauguu

SEQ ID NO: 212635 - RNA, 21 nt, Homo sapiens
ugaacaucacagcaagucugu

SEQ ID NO: 212636 - RNA, 22 nt, Homo sapiens
uccaaguucagaaguguccuga

SEQ ID NO: 212637 - RNA, 22 nt, Homo sapiens
acucaggaacacuucugaacug

SEQ ID NO: 212638 - RNA, 22 nt, Homo sapiens
aaggaccuggacagaggcagaa

SEQ ID NO: 212639 - RNA, 24 nt, Homo sapiens
agcuccgccgcugaguccagcccu

SEQ ID NO: 212640 - RNA, 21 nt, Homo sapiens
aaguggucagugaggcaguca

SEQ ID NO: 212641 - RNA, 24 nt, Homo sapiens
acuaagugccucagaaaccaaauu

SEQ ID NO: 212642 - RNA, 21 nt, Homo sapiens
ccccaacaaccuagaaaagua

SEQ ID NO: 212643 - RNA, 23 nt, Homo sapiens
ucuacccugcaagguuguuguga

SEQ ID NO: 212644 - RNA, 22 nt, Homo sapiens
cugaggcccaggaaaauccaag

SEQ ID NO: 212645 - RNA, 22 nt, Homo sapiens
ucgugaauuugcccuguccuca

SEQ ID NO: 212646 - RNA, 21 nt, Homo sapiens
cugccaggauggaaagggaaa

SEQ ID NO: 212647 - RNA, 21 nt, Homo sapiens
uuccaccuccugcccuggcaa

SEQ ID NO: 212648 - RNA, 22 nt, Homo sapiens
auuagaguuugguucauaugau

SEQ ID NO: 212649 - RNA, 22 nt, Homo sapiens
aaaccauaucagccagacucua

SEQ ID NO: 212650 - RNA, 21 nt, Homo sapiens
gcgaggcccugggagcacagg

SEQ ID NO: 212651 - RNA, 22 nt, Homo sapiens
ccacugugccccaagggccuca

SEQ ID NO: 212652 - RNA, 22 nt, Homo sapiens
uuuuggacuuucagauuuagga

SEQ ID NO: 212653 - RNA, 24 nt, Homo sapiens
auccccaaaucugaaaaaguccaa

SEQ ID NO: 212654 - RNA, 22 nt, Homo sapiens
cuggggaaugggagacacaaaa

SEQ ID NO: 212655 - RNA, 22 nt, Homo sapiens
aauuuugcucugccaucccccu

SEQ ID NO: 212656 - RNA, 22 nt, Homo sapiens
uguuauauauacagccaugcac

SEQ ID NO: 212657 - RNA, 21 nt, Homo sapiens
gagugcauggcuguauauaua

SEQ ID NO: 212658 - RNA, 21 nt, Homo sapiens
accuuacaaccgcagcugcaa

SEQ ID NO: 212659 - RNA, 23 nt, Homo sapiens
caugccagcaaagcuacaaaccc

SEQ ID NO: 212660 - RNA, 23 nt, Homo sapiens
cuccauccaaucccugagcccug

SEQ ID NO: 212661 - RNA, 23 nt, Homo sapiens
ucagugggauuuccgaguagcau

SEQ ID NO: 212662 - RNA, 21 nt, Homo sapiens
gaugcuacucagaaaucccac

SEQ ID NO: 212663 - RNA, 23 nt, Homo sapiens
cacccuacaccaaucugccccgg

SEQ ID NO: 212664 - RNA, 23 nt, Homo sapiens
cagcacagucuugucgucuccgu

SEQ ID NO: 212665 - RNA, 22 nt, Homo sapiens
gaugccaagcucagcguggauu

SEQ ID NO: 212666 - RNA, 23 nt, Homo sapiens
gcuccuagccagccucauuuccu

SEQ ID NO: 212667 - RNA, 22 nt, Homo sapiens
agguucaaggcauucacugauu

SEQ ID NO: 212668 - RNA, 21 nt, Homo sapiens
cgcggugguucacgccuguaa

SEQ ID NO: 212669 - RNA, 21 nt, Homo sapiens
gccugaccaacauggugaaac

SEQ ID NO: 212670 - RNA, 22 nt, Homo sapiens
agaggcaccgcugggaucugaa

SEQ ID NO: 212671 - RNA, 21 nt, Homo sapiens
accugauuucuaccaaucucu

SEQ ID NO: 212672 - RNA, 21 nt, Homo sapiens
cugaggaaaagaggauucagu

SEQ ID NO: 212673 - RNA, 22 nt, Homo sapiens
uccacuucaaucccucauccca

SEQ ID NO: 212674 - RNA, 23 nt, Homo sapiens
cuccgguuuaaauggguccgauu

SEQ ID NO: 212675 - RNA, 24 nt, Homo sapiens
ccuguccauccgccugugcccaga

SEQ ID NO: 212676 - RNA, 21 nt, Homo sapiens
uggcuccagcucagucacugg

SEQ ID NO: 212677 - RNA, 22 nt, Homo sapiens
agcacuucauucuuccuauccu

SEQ ID NO: 212678 - RNA, 22 nt, Homo sapiens
accaccuggaauccacucuccu

SEQ ID NO: 212679 - RNA, 22 nt, Homo sapiens
acugggaugagguagaggagga

SEQ ID NO: 212680 - RNA, 22 nt, Homo sapiens
ccaucccauuccaaaccccuca

SEQ ID NO: 212681 - RNA, 21 nt, Homo sapiens
agcccccucagagaacuggau

SEQ ID NO: 212682 - RNA, 22 nt, Homo sapiens
ccauccaguugccuuagggguu

SEQ ID NO: 212683 - RNA, 21 nt, Homo sapiens
cugggagggagacgaggauga

SEQ ID NO: 212684 - RNA, 22 nt, Homo sapiens
cccaacccucguccccuucccu

SEQ ID NO: 212685 - RNA, 23 nt, Homo sapiens
auucgaugacucagucucuucuu

SEQ ID NO: 212686 - RNA, 23 nt, Homo sapiens
ucaagaaugaguuugugccauug

SEQ ID NO: 212687 - RNA, 19 nt, Homo sapiens
cagaggagccuccuaggac

SEQ ID NO: 212688 - RNA, 21 nt, Homo sapiens
gggaggcuccuuugagaauug

SEQ ID NO: 212689 - RNA, 21 nt, Homo sapiens
agcagaccccugcaccccaac

SEQ ID NO: 212690 - RNA, 22 nt, Homo sapiens
gaucugguacuccuuaagcuaa

SEQ ID NO: 212691 - RNA, 21 nt, Homo sapiens
guuagcuuaaggaguaccaua

SEQ ID NO: 212692 - RNA, 22 nt, Homo sapiens
gugcuggcucacuucauaugug

SEQ ID NO: 212693 - RNA, 22 nt, Homo sapiens
acacauaugaaaugagccagca

SEQ ID NO: 212694 - RNA, 22 nt, Homo sapiens
ggaacuucuaggaggcauggaa

SEQ ID NO: 212695 - RNA, 22 nt, Homo sapiens
ucuccauuucuccuggaaggcu

SEQ ID NO: 212696 - RNA, 22 nt, Homo sapiens
ccuaggcacacuuaaaguuuua

SEQ ID NO: 212697 - RNA, 22 nt, Homo sapiens
gcuauaacuuuaagugugccua

SEQ ID NO: 212698 - RNA, 22 nt, Homo sapiens
ccaaacuaauauacccauauuc

SEQ ID NO: 212699 - RNA, 22 nt, Homo sapiens
cagaauauggguauauuaguuu

SEQ ID NO: 212700 - RNA, 22 nt, Homo sapiens
aauugggcaaagggaagaacua

SEQ ID NO: 212701 - RNA, 22 nt, Homo sapiens
ucuaguucuucccauuucccug

SEQ ID NO: 212702 - RNA, 22 nt, Homo sapiens
accuguagucccagcuauucag

SEQ ID NO: 212703 - RNA, 22 nt, Homo sapiens
cucucgaguagcugguacuuca

SEQ ID NO: 212704 - RNA, 22 nt, Homo sapiens
cuuuaaccagcuugucacucug

SEQ ID NO: 212705 - RNA, 22 nt, Homo sapiens
gcauauaguaacaagcuggaua

SEQ ID NO: 212706 - RNA, 21 nt, Homo sapiens
gaugaucacacugcccggggc

SEQ ID NO: 212707 - RNA, 18 nt, Homo sapiens
agucccggaggugaccau

SEQ ID NO: 212708 - RNA, 19 nt, Homo sapiens
gcuggcauuagugggacuu

SEQ ID NO: 212709 - RNA, 21 nt, Homo sapiens
aaaagucccacuaaugccagu

SEQ ID NO: 212710 - RNA, 23 nt, Homo sapiens
ugggagcuagguugccaugugca

SEQ ID NO: 212711 - RNA, 21 nt, Homo sapiens
acugcacaagagcacccagcc

SEQ ID NO: 212712 - RNA, 21 nt, Homo sapiens
uugccauacaugaacuuuauu

SEQ ID NO: 212713 - RNA, 21 nt, Homo sapiens
aauaaagucuauguauggcaa

SEQ ID NO: 212714 - RNA, 21 nt, Homo sapiens
ugggagcuaagcuauggguau

SEQ ID NO: 212715 - RNA, 21 nt, Homo sapiens
auacccauagcuuagcuccca

SEQ ID NO: 212716 - RNA, 22 nt, Homo sapiens
gcagauuaguccagcauuucuc

SEQ ID NO: 212717 - RNA, 22 nt, Homo sapiens
aagagguauugccacccuuucu

SEQ ID NO: 212718 - RNA, 22 nt, Homo sapiens
acuagaaaggguggcaauaccu

SEQ ID NO: 212719 - RNA, 22 nt, Homo sapiens
accuuauccugcaaggugcuac

SEQ ID NO: 212720 - RNA, 24 nt, Homo sapiens
gaagucagagaaucugcaucugua

SEQ ID NO: 212721 - RNA, 20 nt, Homo sapiens
cuguugcucaggcuagaguu

SEQ ID NO: 212722 - RNA, 22 nt, Homo sapiens
cccgugauaacugcugggcugu

SEQ ID NO: 212723 - RNA, 21 nt, Homo sapiens
acaauacaauacgauacgaua

SEQ ID NO: 212724 - RNA, 22 nt, Homo sapiens
auuugacccuaaaacguucuaa

SEQ ID NO: 212725 - RNA, 22 nt, Homo sapiens
gcuguuuuacagguguuuguua

SEQ ID NO: 212726 - RNA, 22 nt, Homo sapiens
ucuaggacuacagguguaugcu

SEQ ID NO: 212727 - RNA, 21 nt, Homo sapiens
ccuaauagagguaguagcuga

SEQ ID NO: 212728 - RNA, 22 nt, Homo sapiens
gcuuucucggagcucagagcaa

SEQ ID NO: 212729 - RNA, 22 nt, Homo sapiens
acacccacugugguauuauuug

SEQ ID NO: 212730 - RNA, 20 nt, Homo sapiens
acaccuacugugauauuauu

SEQ ID NO: 212731 - RNA, 22 nt, Homo sapiens
guacaccuacugugauauuauu

SEQ ID NO: 212732 - RNA, 22 nt, Homo sapiens
gaguucauuucagagccacugc

SEQ ID NO: 212733 - RNA, 21 nt, Homo sapiens
cugagacagucccaugaucug

SEQ ID NO: 212734 - RNA, 22 nt, Homo sapiens
cugucuagauucuucuuggagu

SEQ ID NO: 212735 - RNA, 22 nt, Homo sapiens
ggcaucagacuacuuaaaugag

SEQ ID NO: 212736 - RNA, 22 nt, Homo sapiens
ccuuuaucaugaaacuacuuga

SEQ ID NO: 212737 - RNA, 22 nt, Homo sapiens
ccacaaucacugcacuccccca

SEQ ID NO: 212738 - RNA, 22 nt, Homo sapiens
gcuccaacaaggaaagacagga

SEQ ID NO: 212739 - RNA, 22 nt, Homo sapiens
ccuucaauaauuuaaugcauua

SEQ ID NO: 212740 - RNA, 19 nt, Homo sapiens
aaucagaacgugacaauaa

SEQ ID NO: 212741 - RNA, 22 nt, Homo sapiens
caugggauauguugcugacuca

SEQ ID NO: 212742 - RNA, 18 nt, Homo sapiens
accuucccgacuucuccu

SEQ ID NO: 212743 - RNA, 22 nt, Homo sapiens
gcauaaugggaugauggccuaa

SEQ ID NO: 212744 - RNA, 23 nt, Homo sapiens
cacaggccaugagccccgaaaca

SEQ ID NO: 212745 - RNA, 22 nt, Homo sapiens
agcuucagcauguuauccagaa

SEQ ID NO: 212746 - RNA, 22 nt, Homo sapiens
gccuuguacagcauucaaacgu

SEQ ID NO: 212747 - RNA, 20 nt, Homo sapiens
ggucaggcacagucgcucau

SEQ ID NO: 212748 - RNA, 20 nt, Homo sapiens
gcuccccauucucucuccgc

SEQ ID NO: 212749 - RNA, 20 nt, Homo sapiens
accuccccgcgccccagccc

SEQ ID NO: 212750 - RNA, 21 nt, Homo sapiens
ccaccgccggagacucgcagg

SEQ ID NO: 212751 - RNA, 21 nt, Homo sapiens
gggggcagcaggcccuagccc

SEQ ID NO: 212752 - RNA, 19 nt, Homo sapiens
cuccagggacuggaaccgg

SEQ ID NO: 212753 - RNA, 19 nt, Homo sapiens
gccuuggccggcagcagaa

SEQ ID NO: 212754 - RNA, 22 nt, Homo sapiens
cuaaggugcagugugaugagga

SEQ ID NO: 212755 - RNA, 20 nt, Homo sapiens
guagcugauaacucacuacc

SEQ ID NO: 212756 - RNA, 20 nt, Homo sapiens
ccaccuagccucugaauauc

SEQ ID NO: 212757 - RNA, 21 nt, Homo sapiens
caccaaugccgccugggccgu

SEQ ID NO: 212758 - RNA, 21 nt, Homo sapiens
ccaccucuccucugucaugcu

SEQ ID NO: 212759 - RNA, 21 nt, Homo sapiens
gaaggccguacagcucuuccc

SEQ ID NO: 212760 - RNA, 19 nt, Homo sapiens
ccacagcuagcucaggcgg

SEQ ID NO: 212761 - RNA, 24 nt, Homo sapiens
cagcuaguugguccaagcuuccaa

SEQ ID NO: 212762 - RNA, 19 nt, Homo sapiens
cgggaacgcccgcacuaga

SEQ ID NO: 212763 - RNA, 24 nt, Homo sapiens
ggcgccuuggccggcacugcuccu

SEQ ID NO: 212764 - RNA, 19 nt, Homo sapiens
ggaucaaccagacguauuc

SEQ ID NO: 212765 - RNA, 20 nt, Homo sapiens
cccacagccucugauauaag

SEQ ID NO: 212766 - RNA, 20 nt, Homo sapiens
ccggccaccgacuggcggaa

SEQ ID NO: 212767 - RNA, 19 nt, Homo sapiens
ugugcucccccagccccuu

SEQ ID NO: 212768 - RNA, 20 nt, Homo sapiens
cucugcccuucccaaccucc

SEQ ID NO: 212769 - RNA, 18 nt, Homo sapiens
gcucgcccccccgccuca

SEQ ID NO: 212770 - RNA, 20 nt, Homo sapiens
cgcccccccgcuucaucucu

SEQ ID NO: 212771 - RNA, 24 nt, Homo sapiens
ccgccccgccccaccccggccucc

SEQ ID NO: 212772 - RNA, 19 nt, Homo sapiens
gccccgccccucgcucccc

SEQ ID NO: 212773 - RNA, 20 nt, Homo sapiens
uccucccccuuccuuuuccc

SEQ ID NO: 212774 - RNA, 20 nt, Homo sapiens
uccgccgcuccgccuuccgc

SEQ ID NO: 212775 - RNA, 18 nt, Homo sapiens
ucuccgccgggccuucac

SEQ ID NO: 212776 - RNA, 19 nt, Homo sapiens
ccucccacccacucccuca

SEQ ID NO: 212777 - RNA, 19 nt, Homo sapiens
uuuugacuccaauuccagu

SEQ ID NO: 212778 - RNA, 19 nt, Homo sapiens
uauacacccaacucccuca

SEQ ID NO: 212779 - RNA, 19 nt, Homo sapiens
cauacaauccacucccuca

SEQ ID NO: 212780 - RNA, 19 nt, Homo sapiens
cacucccaucugaccagcc

SEQ ID NO: 212781 - RNA, 19 nt, Homo sapiens
ugcaauccccagcccugcu

SEQ ID NO: 212782 - RNA, 19 nt, Homo sapiens
uacccaaccuccucccuca

SEQ ID NO: 212783 - RNA, 19 nt, Homo sapiens
ucuacauccuaccaccuca

SEQ ID NO: 212784 - RNA, 19 nt, Homo sapiens
cuccccucaccuccugcug

SEQ ID NO: 212785 - RNA, 22 nt, Homo sapiens
ugugggcaaaacaaacacugcu

SEQ ID NO: 212786 - RNA, 22 nt, Homo sapiens
acugcagugcucuugcgcccga

SEQ ID NO: 212787 - RNA, 21 nt, Homo sapiens
gcaggucaucccaacaagugu

SEQ ID NO: 212788 - RNA, 24 nt, Homo sapiens
ggacaccuggaguggauagcuccu

SEQ ID NO: 212789 - RNA, 23 nt, Homo sapiens
acuguuaccgcaggcugcucugg

SEQ ID NO: 212790 - RNA, 22 nt, Homo sapiens
accaaaggcagcccuggcaacu

SEQ ID NO: 212791 - RNA, 21 nt, Homo sapiens
auacucuagaaagauggucua

SEQ ID NO: 212792 - RNA, 22 nt, Homo sapiens
ggucaacaaucuuucuagagcu

SEQ ID NO: 212793 - RNA, 21 nt, Homo sapiens
ggaggucugcauccuaguccc

SEQ ID NO: 212794 - RNA, 23 nt, Homo sapiens
ucuggggauuugaaugcagaccu

SEQ ID NO: 212795 - RNA, 20 nt, Homo sapiens
agaauggcugugcuguaaug

SEQ ID NO: 212796 - RNA, 21 nt, Homo sapiens
cugcauuacagcacagccaga

SEQ ID NO: 212797 - RNA, 21 nt, Homo sapiens
cuuuggaagagguagaaguca

SEQ ID NO: 212798 - RNA, 22 nt, Homo sapiens
gcugagauauccccuauuccaa

SEQ ID NO: 212799 - RNA, 22 nt, Homo sapiens
gugucuggaaucucugauacga

SEQ ID NO: 212800 - RNA, 23 nt, Homo sapiens
accauauucagugacaucccagu

SEQ ID NO: 212801 - RNA, 22 nt, Homo sapiens
gggaaaaauaggaaggacuuug

SEQ ID NO: 212802 - RNA, 21 nt, Homo sapiens
acaaagucccuccuauucuuc

SEQ ID NO: 212803 - RNA, 22 nt, Homo sapiens
aguucuagaaaugcauggccca

SEQ ID NO: 212804 - RNA, 21 nt, Homo sapiens
ggugggucaugcauuucuaga

SEQ ID NO: 212805 - RNA, 22 nt, Homo sapiens
aaauuagguaguggcaguggaa

SEQ ID NO: 212806 - RNA, 21 nt, Homo sapiens
guuccacugccacuaccuaau

SEQ ID NO: 212807 - RNA, 21 nt, Homo sapiens
cugcaggagacagagucggug

SEQ ID NO: 212808 - RNA, 22 nt, Homo sapiens
gacuccucucucuccccugcug

SEQ ID NO: 212809 - RNA, 22 nt, Homo sapiens
gcaggcagaagggauggugagg

SEQ ID NO: 212810 - RNA, 23 nt, Homo sapiens
ccugucagccccacuucugccug

SEQ ID NO: 212811 - RNA, 23 nt, Homo sapiens
ugcaggcagaagggguggugagg

SEQ ID NO: 212812 - RNA, 24 nt, Homo sapiens
ugucagccccacuucugccugcag

SEQ ID NO: 212813 - RNA, 22 nt, Homo sapiens
ccuaccauuagaagggcuggaa

SEQ ID NO: 212814 - RNA, 22 nt, Homo sapiens
ucuuccagcucuucuaauggua

SEQ ID NO: 212815 - RNA, 21 nt, Homo sapiens
cuagggacagaugacacuuga

SEQ ID NO: 212816 - RNA, 23 nt, Homo sapiens
agacauguggcgucaaucccaaa

SEQ ID NO: 212817 - RNA, 21 nt, Homo sapiens
cuggaguggaagaacaggcag

SEQ ID NO: 212818 - RNA, 23 nt, Homo sapiens
gccagcugaaaguccacuccaua

SEQ ID NO: 212819 - RNA, 20 nt, Homo sapiens
cugggggguagaugaagaga

SEQ ID NO: 212820 - RNA, 21 nt, Homo sapiens
gaugucuuccacacccuccaa

SEQ ID NO: 212821 - RNA, 21 nt, Homo sapiens
ccacaggcacgacugguuugg

SEQ ID NO: 212822 - RNA, 22 nt, Homo sapiens
ccacaggcacagccgguuugag

SEQ ID NO: 212823 - RNA, 21 nt, Homo sapiens
ugccaaaccagucgugccugu

SEQ ID NO: 212824 - RNA, 22 nt, Homo sapiens
gcagaggaauggagaguucgga

SEQ ID NO: 212825 - RNA, 20 nt, Homo sapiens
ggcccuuacccccauuccca

SEQ ID NO: 212826 - RNA, 22 nt, Homo sapiens
ucucuacauccccacaucgccu

SEQ ID NO: 212827 - RNA, 21 nt, Homo sapiens
ucauaagcccucugaccacua

SEQ ID NO: 212828 - RNA, 22 nt, Homo sapiens
caggagaaucacugaugucaga

SEQ ID NO: 212829 - RNA, 22 nt, Homo sapiens
ucuaccaguuccugcaggcgcg

SEQ ID NO: 212830 - RNA, 23 nt, Homo sapiens
cuccuacaauaagccccugccca

SEQ ID NO: 212831 - RNA, 22 nt, Homo sapiens
ccuggcccacccgaccccugca

SEQ ID NO: 212832 - RNA, 20 nt, Homo sapiens
gcauguggucgggugcgccu

SEQ ID NO: 212833 - RNA, 22 nt, Homo sapiens
gccccgacguuacucggacuau

SEQ ID NO: 212834 - RNA, 23 nt, Homo sapiens
ccccacgcccgccgcgggcccag

SEQ ID NO: 212835 - RNA, 22 nt, Homo sapiens
ggaaagcuaggaggcuguacag

SEQ ID NO: 212836 - RNA, 21 nt, Homo sapiens
gaaagacaguagauuguauag

SEQ ID NO: 212837 - RNA, 22 nt, Homo sapiens
aacuauacaaccuacuaccuca

SEQ ID NO: 212838 - RNA, 22 nt, Homo sapiens
gggaaggcaguagguuguauag

SEQ ID NO: 212839 - RNA, 22 nt, Homo sapiens
aaccacacaaccuacuaccuca

SEQ ID NO: 212840 - RNA, 22 nt, Homo sapiens
aaccauacaaccuacuaccuca

SEQ ID NO: 212841 - RNA, 22 nt, Homo sapiens
agaaaggcagcaggucguauag

SEQ ID NO: 212842 - RNA, 22 nt, Homo sapiens
aacuaugcaaccuacuaccucu

SEQ ID NO: 212843 - RNA, 22 nt, Homo sapiens
ggaaagcuaggaggccguauag

SEQ ID NO: 212844 - RNA, 22 nt, Homo sapiens
aacuauacaaccuccuaccuca

SEQ ID NO: 212845 - RNA, 22 nt, Homo sapiens
gggaaggcaauagauuguauag

SEQ ID NO: 212846 - RNA, 22 nt, Homo sapiens
ggaaagacaguagacuguauag

SEQ ID NO: 212847 - RNA, 22 nt, Homo sapiens
aacuauacaaucuacuaccuca

SEQ ID NO: 212848 - RNA, 21 nt, Homo sapiens
gcaaggcaguggccuguacag

SEQ ID NO: 212849 - RNA, 22 nt, Homo sapiens
aacuguacaaacuacuaccuca

SEQ ID NO: 212850 - RNA, 22 nt, Homo sapiens
agcaaggcaguagcuugcgcag

SEQ ID NO: 212851 - RNA, 22 nt, Homo sapiens
aacagcacaaacuacuaccuca

SEQ ID NO: 212852 - protein, 61 aa, Homo sapiens
  Payload ID: 907
  Gene Symbol: AKR7L
  Gene Name: aldo-keto reductase family 7-like (gene/pseudogene)
  ENSP ID: ENSP00000402491
  MOD_RES (1)..(1): Any amino acid
XAFLYSDGQSETILGGLGLRMGSSDCRVKIATKANPWIGNSLKPDSVRSQLETSLKRLQCP

SEQ ID NO: 212853 - protein, 143 aa, Homo sapiens
  Payload ID: 907
  Gene Symbol: AKR7L
  Gene Name: aldo-keto reductase family 7-like (gene/pseudogene)
  ENSP ID: ENSP00000402491
VDLFYLHAPDHSAPVEETLRACHQLHQEGKFVELGLSNYAAWEVAEICTLCKSNGWILPTVYQLLEGAPLRGHCPGGEGPAGRVWRQRSQHDLGRPPVDVPPLTAAGCPRGRGHPGHVQPGAAGAELGSGRGRAPGAGCRGRL

SEQ ID NO: 212854 - protein, 105 aa, Homo sapiens
  Payload ID: 907
  Gene Symbol: AKR7L
  Gene Name: aldo-keto reductase family 7-like (gene/pseudogene)
  ENSP ID: ENSP00000411913
MSRQLSRARPATVLGAMEMGRRMDAPTSAAVTRAFLERGHTEIDTAFLYSDGQSETILGGLGLRMGSSDCRVKIATKANPWIGNSLKPDSVRSQLETSLKRLQCP

SEQ ID NO: 212855 - protein, 225 aa, Homo sapiens
  Payload ID: 907
  Gene Symbol: AKR7L
  Gene Name: aldo-keto reductase family 7-like (gene/pseudogene)
  ENSP ID: ENSP00000411913
VDLFYLHAPDHSAPVEETLRACHQLHQEGKFVELGLSNYAAWEVAEICTLCKSNGWILPTVYQGMYSATTRQVETELFPCLRHFGLRFYAYNPLAGGLLTGKYKYEDKDGKQPVGRFFGTQWAEIYRNHFWKEHHFEGIALVEKALQAAYGASAPSMTSAALRWMYHHSQLQGAHGDAVILGMSSLEQLEQNLAAAEEGPLEPAVVDAFNQAWHLFAHECPNYFI

SEQ ID NO: 212856 - protein, 124 aa, Homo sapiens
  Payload ID: 2409
  Gene Symbol: CASP12
  Gene Name: caspase 12 (gene/pseudogene)
  ENSP ID: ENSP00000421815
MADEKPSNGVLVHMVKLLIKTFLDGIFDDLMENNVLNTDEIHLIGKCLKFVVSNAENLVDDITETAQIAGKIFREHLWNSKKQLSSDISSDGEREANMPGLNIRNKEFNYLHNRNGSELDLLGM

SEQ ID NO: 212857 - protein, 101 aa, Homo sapiens
  Payload ID: 2409
  Gene Symbol: CASP12
  Gene Name: caspase 12 (gene/pseudogene)
  ENSP ID: ENSP00000421815
DLLENLGYSVVIKENLTAQMVLGLFGSPLTVEKPVQILMVGSCKVTSVMMLLQRLMWKRTSLLSNLPHHVQHSFETPNILTQLPTIERLSMTRYFYLFPGN

SEQ ID NO: 212858 - protein, 124 aa, Homo sapiens; identical to SEQ ID NO: 212856
  Payload ID: 2409
  Gene Symbol: CASP12
  Gene Name: caspase 12 (gene/pseudogene)
  ENSP ID: ENSP00000423899

SEQ ID NO: 212859 - protein, 99 aa, Homo sapiens
  Payload ID: 2409
  Gene Symbol: CASP12
  Gene Name: caspase 12 (gene/pseudogene)
  ENSP ID: ENSP00000423899
DLLENLGYSVVIKENLTAQMVLGLFGSPLTVEKPVQILMVGSCKVTSVMMLLQRLMWKRTSLLSNLPHHIMFLGDMKQMALSSFPKLSTTSESILGVII

SEQ ID NO: 212860 - protein, 124 aa, Homo sapiens; identical to SEQ ID NO: 212856
  Payload ID: 2409
  Gene Symbol: CASP12
  Gene Name: caspase 12 (gene/pseudogene)
  ENSP ID: ENSP00000423970

SEQ ID NO: 212861 - protein, 170 aa, Homo sapiens
  Payload ID: 2409
  Gene Symbol: CASP12
  Gene Name: caspase 12 (gene/pseudogene)
  ENSP ID: ENSP00000423970
DLLENLGYSVVIKENLTAQEMETALRQFAAHPEHQSSDSTFLVFMSHSILNGICGTKHWDQEPDVLHDDTIFEIFNNRNCQSLKDKPKMVLGLFGSPLTVEKPVQILMVGSCKVTSVMMLLQRLMWKRTSLLSNLPHHVQHSFETPNILTQLPTIERLSMTRYFYLFPGN

SEQ ID NO: 212862 - protein, 124 aa, Homo sapiens; identical to SEQ ID NO: 212856
  Payload ID: 2409
  Gene Symbol: CASP12
  Gene Name: caspase 12 (gene/pseudogene)
  Uniprot ID: Q6UXS9
  ENSP ID: ENSP00000424038

SEQ ID NO: 212863 - protein, 216 aa, Homo sapiens
  Payload ID: 2409
  Gene Symbol: CASP12
  Gene Name: caspase 12 (gene/pseudogene)
  Uniprot ID: Q6UXS9
  ENSP ID: ENSP00000424038
DLLENLGYSVVIKENLTAQEMETALRQFAAHPEHQSSDSTFLVFMSHSILNGICGTKHWDQEPDVLHDDTIFEIFNNRNCQSLKDKPKVIIMQACRGNGAGIVWFTTDSGKASADTHGRLLQGNICNDAVTKAHVEKDFIAFKSSTPHNVSWRHETNGSVFISQIIYYFREYSWSHHLEEIFQKVQHSFETPNILTQLPTIERLSMTRYFYLFPGN

SEQ ID NO: 212864 - protein, 124 aa, Homo sapiens; identical to SEQ ID NO: 212856
  Payload ID: 2409
  Gene Symbol: CASP12
  Gene Name: caspase 12 (gene/pseudogene)
  ENSP ID: ENSP00000425652

SEQ ID NO: 212865 - protein, 152 aa, Homo sapiens
  Payload ID: 2409
  Gene Symbol: CASP12
  Gene Name: caspase 12 (gene/pseudogene)
  ENSP ID: ENSP00000425652
DLLENLGYSVVIKENLTAQEMETALRQFAAHPEHQSSDSTFLVFMSHSILNGICGTKHWDQEPDVLHDDTIFEIFNNRNCQSLKDKPKVIIMQACRGNGAGIVWFTTDSGKASADTHGRLLQGNICNDAVTKAHVEKDFIAFKSSTPRSTFI

SEQ ID NO: 212866 - protein, 40 aa, Homo sapiens
  Payload ID: 2409
  Gene Symbol: CASP12
  Gene Name: caspase 12 (gene/pseudogene)
  ENSP ID: ENSP00000426427
MADISSDGEREANMPGLNIRNKEFNYLHNRNGSELDLLGM

SEQ ID NO: 212867 - protein, 99 aa, Homo sapiens; identical to SEQ ID NO: 212859
  Payload ID: 2409
  Gene Symbol: CASP12
  Gene Name: caspase 12 (gene/pseudogene)
  ENSP ID: ENSP00000426427

SEQ ID NO: 212868 - protein, 40 aa, Homo sapiens; identical to SEQ ID NO: 212866
  Payload ID: 2409
  Gene Symbol: CASP12
  Gene Name: caspase 12 (gene/pseudogene)
  Uniprot ID: Q6UXS9
  ENSP ID: ENSP00000426566

SEQ ID NO: 212869 - protein, 216 aa, Homo sapiens; identical to SEQ ID NO: 212863
  Payload ID: 2409
  Gene Symbol: CASP12
  Gene Name: caspase 12 (gene/pseudogene)
  Uniprot ID: Q6UXS9
  ENSP ID: ENSP00000426566

SEQ ID NO: 212870 - protein, 40 aa, Homo sapiens; identical to SEQ ID NO: 212866
  Payload ID: 2409
  Gene Symbol: CASP12
  Gene Name: caspase 12 (gene/pseudogene)
  ENSP ID: ENSP00000427437

SEQ ID NO: 212871 - protein, 101 aa, Homo sapiens; identical to SEQ ID NO: 212857
  Payload ID: 2409
  Gene Symbol: CASP12
  Gene Name: caspase 12 (gene/pseudogene)
  ENSP ID: ENSP00000427437

SEQ ID NO: 212872 - protein, 124 aa, Homo sapiens; identical to SEQ ID NO: 212856
  Payload ID: 2409
  Gene Symbol: CASP12
  Gene Name: caspase 12 (gene/pseudogene)
  ENSP ID: ENSP00000482745

SEQ ID NO: 212873 - protein, 216 aa, Homo sapiens; identical to SEQ ID NO: 212863
  Payload ID: 2409
  Gene Symbol: CASP12
  Gene Name: caspase 12 (gene/pseudogene)
  ENSP ID: ENSP00000482745

SEQ ID NO: 212874 - protein, 404 aa, Homo sapiens
  Payload ID: 3357
  Gene Symbol: C6orf183
  Gene Name: chromosome 6 open reading frame 183
  ENSP ID: ENSP00000475092
MDEIYKITSTERVQLLEKKLAVQLTELKSEIEEQGALQGTANRVYSSIQMPKDIYYFRRERELALKKTLQVAESKPLVVQADAVQRELESCLRREYTPENLPLLLLQYYTERIAQLAQSKYLHMLRWKRFCQHSKIMEQLYPLYKKQVGYIMQEYNDTLQRAERLSVARENFLMGKNNPPNLVTQEDLTIYTKWLVCHLHSLGTVHQYLQALQYLPISKVLSVAFNRVAEAGQKNENVCVNDIDPDIQGSASPDPVDTSISGPMRTEAAFVLPQHATETGELKPQLKLLLSHFSIPYDVEELWDSAKEMELFSLVSQKFQSVFMEQQRLQMFPDCEAGIAKADNLGLAGPRMTLKKKANWISFIKIKPKCDPWQKKLLTKLKERRRTDALLQLQAKFLKISNPE

SEQ ID NO: 212875 - protein, 220 aa, Homo sapiens
  Payload ID: 3357
  Gene Symbol: C6orf183
  Gene Name: chromosome 6 open reading frame 183
  ENSP ID: ENSP00000475092
VMQVLQDHAAKTVMLAPHQPSFVASQGLHQGNYDQVWENIDNNINLCQNKNMKDDDLSMKQNENDLSQITLSQHADGPLKQIQETGYNYAMTLQLLGLEDGTDPSDRNPVLMRGAYLSFLYLCHLRIRELQHICLGILNYFRSVERTLTINTSGLTLVSGKLVPTMEDSSWVNMAKGGLGTLQGLGAHHYVRETPAEHKVHSVQFMEFSEVENQDDYYST

SEQ ID NO: 212876 - protein, 252 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000439604
MGLEALVPLAMIVAIFLLLVDLMHRHQRWAARYPPGPLPLPGLGNLAACGLPEHTILLRPVAAPLRGRVQPAAGLDAGGRAQWAGGRARGDGDPRRGHGRPPACAHLPGPGLRAAFPRGDPVALWARVARAEALLRVHLAQLGPGQEVAGAVGDRGGRLPLCRLRRPSRTPLSPQRPLGQSREQRDRLPHLRAPLRVRRPSLPQAAGPSSGGTEGGVGLPARGAECCPRPPAHPSAGWQGPTLPKGFPDPAG

SEQ ID NO: 212877 - protein, 3 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000439604
AAN

SEQ ID NO: 212878 - protein, 15 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000439604
AQDDLGPSPATPRPD

SEQ ID NO: 212879 - protein, 13 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000439604
GLPGKEGEGQGEP

SEQ ID NO: 212880 - protein, 4 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000439604
EQLQ

SEQ ID NO: 212881 - protein, 7 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000439604
EPAHSGG

SEQ ID NO: 212882 - protein, 66 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000439604
PVPCRDGDHLDHAGLGPPAHDPTPGCAARKESVPWVLTHCGDACLSSPCPTGDRRRDRAGAATRDG

SEQ ID NO: 212883 - protein, 31 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000439604
PGSHALHHCRDSRGAALWGHRPPGCDPYDIP

SEQ ID NO: 212884 - protein, 9 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000439604
HRSTGLPHP

SEQ ID NO: 212885 - protein, 14 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000439604
GNDTHHQPVIGAEG

SEQ ID NO: 212886 - protein, 91 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000439604
GRLEEALPLPPRTLPGCPGPLCEAGGLPAFLSRPPCMPRGAPGPHGALPLLHLPAAALQLLRGRRTAPAQPLSCRQLSGDPIPLRALCCAP

SEQ ID NO: 212887 - protein, 252 aa, Homo sapiens; identical to SEQ ID NO: 212876
  Payload ID: 4434
  Gene Symbol: CYP2D7
  Gene Name: cytochrome P450, family 2, subfamily D, polypeptide 7 (gene/pseudogene)
  ENSP ID: ENSP00000445124

SEQ ID NO: 212888 - protein, 3 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000445124
AAN

SEQ ID NO: 212889 - protein, 15 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000445124
AQDDLGPSPATPRPD

SEQ ID NO: 212890 - protein, 13 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000445124
GLPGKEGEGQGEP

SEQ ID NO: 212891 - protein, 4 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000445124
EQLQ

SEQ ID NO: 212892 - protein, 7 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000445124
EPAHSGG

SEQ ID NO: 212893 - protein, 47 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000445124
PVPCRDGDHLDHAGLGPPAHDPTPGCAAPCPTGDRRRDRAGAATRDG

SEQ ID NO: 212894 - protein, 31 aa, Homo sapiens; identical to SEQ ID NO: 212883
  Payload ID: 4434
  Gene Symbol: CYP2D7
  Gene Name: cytochrome P450, family 2, subfamily D, polypeptide 7 (gene/pseudogene)
  ENSP ID: ENSP00000445124

SEQ ID NO: 212895 - protein, 9 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000445124
HRSTGLPHP

SEQ ID NO: 212896 - protein, 14 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000445124
GNDTHHQPVIGAEG

SEQ ID NO: 212897 - protein, 91 aa, Homo sapiens; identical to SEQ ID NO: 212886
  Payload ID: 4434
  Gene Symbol: CYP2D7
  Gene Name: cytochrome P450, family 2, subfamily D, polypeptide 7 (gene/pseudogene)
  ENSP ID: ENSP00000445124

SEQ ID NO: 212898 - protein, 252 aa, Homo sapiens; identical to SEQ ID NO: 212876
  Payload ID: 4434
  Gene Symbol: CYP2D7
  Gene Name: cytochrome P450, family 2, subfamily D, polypeptide 7 (gene/pseudogene)
  ENSP ID: ENSP00000461363

SEQ ID NO: 212899 - protein, 3 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000461363
AAN

SEQ ID NO: 212900 - protein, 15 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000461363
AQDDLGPSPATPRPD

SEQ ID NO: 212901 - protein, 13 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000461363
GLPGKEGEGQGEP

SEQ ID NO: 212902 - protein, 4 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000461363
EQLQ

SEQ ID NO: 212903 - protein, 7 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000461363
EPAHSGG

SEQ ID NO: 212904 - protein, 66 aa, Homo sapiens; identical to SEQ ID NO: 212882
  Payload ID: 4434
  Gene Symbol: CYP2D7
  Gene Name: cytochrome P450, family 2, subfamily D, polypeptide 7 (gene/pseudogene)
  ENSP ID: ENSP00000461363

SEQ ID NO: 212905 - protein, 31 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000461363
PGSHALHHCRDSRGAALWGHHPPECDPYDIP

SEQ ID NO: 212906 - protein, 9 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000461363
HRSTGLPHP

SEQ ID NO: 212907 - protein, 14 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000461363
GNDTHHQPVIGAEG

SEQ ID NO: 212908 - protein, 92 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000461363
GRLEEALPLPPRTLPGCPGPLCEAGGLPAFLSRPPCMPRGAPGPHGALPLLHLPAAALQLLRGRRTAPAQPLSCRQLSGDPIPLRALCCAPL

SEQ ID NO: 212909 - protein, 252 aa, Homo sapiens; identical to SEQ ID NO: 212876
  Payload ID: 4434
  Gene Symbol: CYP2D7
  Gene Name: cytochrome P450, family 2, subfamily D, polypeptide 7 (gene/pseudogene)
  ENSP ID: ENSP00000461768

SEQ ID NO: 212910 - protein, 3 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000461768
AAN

SEQ ID NO: 212911 - protein, 15 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000461768
AQDDLGPSPATPRPD

SEQ ID NO: 212912 - protein, 13 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000461768
GLPGKEGEGQGEP

SEQ ID NO: 212913 - protein, 4 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000461768
EQLQ

SEQ ID NO: 212914 - protein, 7 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000461768
EPAHSGG

SEQ ID NO: 212915 - protein, 47 aa, Homo sapiens; identical to SEQ ID NO: 212893
  Payload ID: 4434
  Gene Symbol: CYP2D7
  Gene Name: cytochrome P450, family 2, subfamily D, polypeptide 7 (gene/pseudogene)
  ENSP ID: ENSP00000461768

SEQ ID NO: 212916 - protein, 31 aa, Homo sapiens; identical to SEQ ID NO: 212905
  Payload ID: 4434
  Gene Symbol: CYP2D7
  Gene Name: cytochrome P450, family 2, subfamily D, polypeptide 7 (gene/pseudogene)
  ENSP ID: ENSP00000461768

SEQ ID NO: 212917 - protein, 9 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000461768
HRSTGLPHP

SEQ ID NO: 212918 - protein, 14 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000461768
GNDTHHQPVIGAEG

SEQ ID NO: 212919 - protein, 92 aa, Homo sapiens; identical to SEQ ID NO: 212908
  Payload ID: 4434
  Gene Symbol: CYP2D7
  Gene Name: cytochrome P450, family 2, subfamily D, polypeptide 7 (gene/pseudogene)
  ENSP ID: ENSP00000461768

SEQ ID NO: 212920 - protein, 252 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000478656
MGLEALVPLAMIVAIFLLLVDLMHRHQRWAARYPPGPLPLPGLGNLAACGLPEHTILLRPVAAPLRGRVQPAAGLDAGGRAQWAGGRARGDGDPRRGHGRPPACAHLPGPGLRAAFPRGVPVALWARVARAEALLRVHLAQLGPGQEVAGAVGDRGGRLPLCRLRRPSRTPLSPQRSLGQSREQRDRLPHLRAPLRVRRPSLPQAAGPSSGGTEGGVGLPARGAECCPRPPAHPSAGWQGPTLPKGFPDPAG

SEQ ID NO: 212921 - protein, 3 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000478656
AAN

SEQ ID NO: 212922 - protein, 15 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000478656
AQDDLGPSPATPRPD

SEQ ID NO: 212923 - protein, 13 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000478656
GLPGKEGEGQGEP

SEQ ID NO: 212924 - protein, 4 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000478656
EQLQ

SEQ ID NO: 212925 - protein, 7 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000478656
EPAHSGG

SEQ ID NO: 212926 - protein, 66 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000478656
PVPCRDGDHLDHAGLGPPAHDPTPGCAATKESVPWVLTHCGDACLSSPCPTGDRRRDRAGAATRDG

SEQ ID NO: 212927 - protein, 31 aa, Homo sapiens; identical to SEQ ID NO: 212905
  Payload ID: 4434
  Gene Symbol: CYP2D7
  Gene Name: cytochrome P450, family 2, subfamily D, polypeptide 7 (gene/pseudogene)
  ENSP ID: ENSP00000478656

SEQ ID NO: 212928 - protein, 9 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000478656
HRSTGLPHP

SEQ ID NO: 212929 - protein, 14 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000478656
GNDTHHQPVIGAEG

SEQ ID NO: 212930 - protein, 92 aa, Homo sapiens; identical to SEQ ID NO: 212908
  Payload ID: 4434
  Gene Symbol: CYP2D7
  Gene Name: cytochrome P450, family 2, subfamily D, polypeptide 7 (gene/pseudogene)
  ENSP ID: ENSP00000478656

SEQ ID NO: 212931 - protein, 252 aa, Homo sapiens; identical to SEQ ID NO: 212920
  Payload ID: 4434
  Gene Symbol: CYP2D7
  Gene Name: cytochrome P450, family 2, subfamily D, polypeptide 7 (gene/pseudogene)
  ENSP ID: ENSP00000487044

SEQ ID NO: 212932 - protein, 3 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000487044
AAN

SEQ ID NO: 212933 - protein, 15 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000487044
AQDDLGPSPATPRPD

SEQ ID NO: 212934 - protein, 13 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000487044
GLPGKEGEGQGEP

SEQ ID NO: 212935 - protein, 4 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000487044
EQLQ

SEQ ID NO: 212936 - protein, 7 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000487044
EPAHSGG

SEQ ID NO: 212937 - protein, 47 aa, Homo sapiens; identical to SEQ ID NO: 212893
  Payload ID: 4434
  Gene Symbol: CYP2D7
  Gene Name: cytochrome P450, family 2, subfamily D, polypeptide 7 (gene/pseudogene)
  ENSP ID: ENSP00000487044

SEQ ID NO: 212938 - protein, 31 aa, Homo sapiens; identical to SEQ ID NO: 212905
  Payload ID: 4434
  Gene Symbol: CYP2D7
  Gene Name: cytochrome P450, family 2, subfamily D, polypeptide 7 (gene/pseudogene)
  ENSP ID: ENSP00000487044

SEQ ID NO: 212939 - protein, 9 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000487044
HRSTGLPHP

SEQ ID NO: 212940 - protein, 14 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000487044
GNDTHHQPVIGAEG

SEQ ID NO: 212941 - protein, 92 aa, Homo sapiens; identical to SEQ ID NO: 212908
  Payload ID: 4434
  Gene Symbol: CYP2D7
  Gene Name: cytochrome P450, family 2, subfamily D, polypeptide 7 (gene/pseudogene)
  ENSP ID: ENSP00000487044

SEQ ID NO: 212942 - protein, 252 aa, Homo sapiens; identical to SEQ ID NO: 212876
  Payload ID: 4434
  Gene Symbol: CYP2D7
  Gene Name: cytochrome P450, family 2, subfamily D, polypeptide 7 (gene/pseudogene)
  ENSP ID: ENSP00000488911

SEQ ID NO: 212943 - protein, 3 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000488911
AAN

SEQ ID NO: 212944 - protein, 15 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000488911
AQDDLGPSPATPRPD

SEQ ID NO: 212945 - protein, 13 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000488911
GLPGKEGEGQGEP

SEQ ID NO: 212946 - protein, 4 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000488911
EQLQ

SEQ ID NO: 212947 - protein, 7 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000488911
EPAHSGG

SEQ ID NO: 212948 - protein, 47 aa, Homo sapiens; identical to SEQ ID NO: 212893
  Payload ID: 4434
  Gene Symbol: CYP2D7
  Gene Name: cytochrome P450, family 2, subfamily D, polypeptide 7 (gene/pseudogene)
  ENSP ID: ENSP00000488911

SEQ ID NO: 212949 - protein, 12 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000488911
PGSHALHHCRDS

SEQ ID NO: 212950 - protein, 18 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000488911
GAALWGHRPPGCDPYDIP

SEQ ID NO: 212951 - protein, 9 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000488911
HRSTGLPHP

SEQ ID NO: 212952 - protein, 14 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000488911
GNDTHHQPVIGAEG

SEQ ID NO: 212953 - protein, 91 aa, Homo sapiens; identical to SEQ ID NO: 212886
  Payload ID: 4434
  Gene Symbol: CYP2D7
  Gene Name: cytochrome P450, family 2, subfamily D, polypeptide 7 (gene/pseudogene)
  ENSP ID: ENSP00000488911

SEQ ID NO: 212954 - protein, 252 aa, Homo sapiens; identical to SEQ ID NO: 212876
  Payload ID: 4434
  Gene Symbol: CYP2D7
  Gene Name: cytochrome P450, family 2, subfamily D, polypeptide 7 (gene/pseudogene)
  ENSP ID: ENSP00000489014

SEQ ID NO: 212955 - protein, 3 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000489014
AAN

SEQ ID NO: 212956 - protein, 15 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000489014
AQDDLGPSPATPRPD

SEQ ID NO: 212957 - protein, 13 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000489014
GLPGKEGEGQGEP

SEQ ID NO: 212958 - protein, 4 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000489014
EQLQ

SEQ ID NO: 212959 - protein, 7 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000489014
EPAHSGG

SEQ ID NO: 212960 - protein, 66 aa, Homo sapiens; identical to SEQ ID NO: 212882
  Payload ID: 4434
  Gene Symbol: CYP2D7
  Gene Name: cytochrome P450, family 2, subfamily D, polypeptide 7 (gene/pseudogene)
  ENSP ID: ENSP00000489014

SEQ ID NO: 212961 - protein, 12 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000489014
PGSHALHHCRDS

SEQ ID NO: 212962 - protein, 18 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000489014
GAALWGHRPPGCDPYDIP

SEQ ID NO: 212963 - protein, 9 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000489014
HRSTGLPHP

SEQ ID NO: 212964 - protein, 14 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000489014
GNDTHHQPVIGAEG

SEQ ID NO: 212965 - protein, 91 aa, Homo sapiens; identical to SEQ ID NO: 212886
  Payload ID: 4434
  Gene Symbol: CYP2D7
  Gene Name: cytochrome P450, family 2, subfamily D, polypeptide 7 (gene/pseudogene)
  ENSP ID: ENSP00000489014

SEQ ID NO: 212966 - protein, 56 aa, Homo sapiens
  Payload ID: 6146
  Gene Symbol: FCGR2C
  Gene Name: Fc fragment of IgG, low affinity IIc, receptor for (CD32) (gene/pseudogene)
  ENSP ID: ENSP00000426627
MGILSFLPVLATESDWADCKSPQPWGHMLLWTAVLFLAPVAGTPAAPPKAVLKLEP

SEQ ID NO: 212967 - protein, 266 aa, Homo sapiens
  Payload ID: 6146
  Gene Symbol: FCGR2C
  Gene Name: Fc fragment of IgG, low affinity IIc, receptor for (CD32) (gene/pseudogene)
  ENSP ID: ENSP00000426627
WINVLQEDSVTLTCRGTHSPESDSIPWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANSTDPVKAAQFEPPGRQMIAIRKRQPEETNNDYETADGGYMTLNPRAPTDDDKNIYLTLPPNDHVNSNN

SEQ ID NO: 212968 - protein, 148 aa, Homo sapiens
  Payload ID: 6893
  Gene Symbol: GBA3
  Gene Name: glucosidase, beta, acid 3 (gene/pseudogene)
  ENSP ID: ENSP00000422220
MAFPAGFGWAAATAAYQVEGGWDADGKGPCVWDTFTHQGGERVFKNQTGDVACGSYTLWEEDLKCIKQLGLTHYRFSLSWSRLLPDGTTGFINQKAIQLDKVNLQVYCAWSLLDNFEWNQGYSSRFGLFHVDFEDPARPRVPYTSAKE

SEQ ID NO: 212969 - protein, 13 aa, Homo sapiens
  Payload ID: 6893
  Gene Symbol: GBA3
  Gene Name: glucosidase, beta, acid 3 (gene/pseudogene)
  ENSP ID: ENSP00000422220
AKIIRNNGLEAHL

SEQ ID NO: 212970 - protein, 284 aa, Homo sapiens
  Payload ID: 6893
  Gene Symbol: GBA3
  Gene Name: glucosidase, beta, acid 3 (gene/pseudogene)
  ENSP ID: ENSP00000423754
MSYDLGMFPPGIPHFGTGGYQAAHNLIKAHARSWHSYDSLFRKKQKGMVSLSLFAVWLEPADPNSVSDQEAAKRAITFHLDLFAKPIFIDGDYPEVVKSQIASMSQKQGYPSSRLPEFTEEEKKMIKGTADFFAVQYYTTRLIKYQENKKGELGILQDAEIEFFPDPSWKNVDWIYVVPWGVCKLLKYIKDTYNNPVIYITENGFPQSDPAPLDDTQRWEYFRQTFQELFKAIQLDKVNLQVYCAWSLLDNFEWNQGYSSRFGLFHVDFEDPARPRVPYTSAKE

SEQ ID NO: 212971 - protein, 13 aa, Homo sapiens
  Payload ID: 6893
  Gene Symbol: GBA3
  Gene Name: glucosidase, beta, acid 3 (gene/pseudogene)
  ENSP ID: ENSP00000423754
AKIIRNNGLEAHL

SEQ ID NO: 212972 - protein, 455 aa, Homo sapiens [sequence omitted]

SEQ ID NO: 212973 - protein, 13 aa, Homo sapiens
  Payload ID: 6893
  Gene Symbol: GBA3
  Gene Name: glucosidase, beta, acid 3 (gene/pseudogene)
  ENSP ID: ENSP00000427458
AKIIRNNGLEAHL

SEQ ID NO: 212974 - protein, 181 aa, Homo sapiens
  Payload ID: 6996
  Gene Symbol: GSTT2
  Gene Name: glutathione S-transferase theta 2 (gene/pseudogene)
  ENSP ID: ENSP00000385765
MGLELFLDLVSQPSRAVYIFAKKNGIPLELRTVDLVKGQHKSKEFLQINSLGKLPTLKDGDFILTESSAILIYLSCKYQTPDHWYPSDLQARARVHEYLGWHADCIRGTFGIPLWVQMLGPLIGVQVPEEKVERNRTAMDQALQWLEDKFLGDRPFLAGQQPVALGYELFEGRPRLAAWRG

SEQ ID NO: 212975 - protein, 48 aa, Homo sapiens
  Payload ID: 6996
  Gene Symbol: GSTT2
  Gene Name: glutathione S-transferase theta 2 (gene/pseudogene)
  ENSP ID: ENSP00000385765
VEAFLGAELCQEAHSIILSILEQAAKKTLPTPSPEAYQAMLLRIARIP

SEQ ID NO: 212976 - protein, 195 aa, Homo sapiens
  Payload ID: 6996
  Gene Symbol: GSTT2
  Gene Name: glutathione S-transferase theta 2 (gene/pseudogene)
  ENSP ID: ENSP00000488993
MGLELFLDLVSQPSRAVYIFAKKNGIPLELRTVDLVKGQHKSKEFLQINSLGKLPTLKDGDFILTESSAILIYLSCKYQTPDHWYPSDLQARARVHEYLGWHADCIRGTFGIPLWVQMLGPLIGVQVPEEKVERNRTAMDQALQWLEDKFLGDRPFLAGQQVTLADLMALEELMQPVALGYELFEGRPRLAAWRG

SEQ ID NO: 212977 - protein, 48 aa, Homo sapiens; identical to SEQ ID NO: 212975
  Payload ID: 6996
  Gene Symbol: GSTT2
  Gene Name: glutathione S-transferase theta 2 (gene/pseudogene)
  ENSP ID: ENSP00000488993

SEQ ID NO: 212978 - protein, 3 aa, Homo sapiens
  Payload ID: 7944
  Gene Symbol: IGHD2OR15-2A
  Gene Name: immunoglobulin heavy diversity 2/OR15-2A (non-functional)
  ENSP ID: ENSP00000474065
RIL

SEQ ID NO: 212979 - protein, 5 aa, Homo sapiens
  Payload ID: 7944
  Gene Symbol: IGHD2OR15-2A
  Gene Name: immunoglobulin heavy diversity 2/OR15-2A (non-functional)
  ENSP ID: ENSP00000474065
YYFLC

SEQ ID NO: 212980 - protein, 3 aa, Homo sapiens
  Payload ID: 7945
  Gene Symbol: IGHD2OR15-2B
  Gene Name: immunoglobulin heavy diversity 2/OR15-2B (non-functional)
  ENSP ID: ENSP00000474017
RIL

SEQ ID NO: 212981 - protein, 5 aa, Homo sapiens
  Payload ID: 7945
  Gene Symbol: IGHD2OR15-2B
  Gene Name: immunoglobulin heavy diversity 2/OR15-2B (non-functional)
  ENSP ID: ENSP00000474017
YYFLC

SEQ ID NO: 212982 - protein, 3 aa, Homo sapiens
  Payload ID: 7946
  Gene Symbol: IGHD2-15
  Gene Name: immunoglobulin heavy diversity 2-15
  ENSP ID: ENSP00000427969
RIL

SEQ ID NO: 212983 - protein, 2 aa, Homo sapiens
  Payload ID: 7946
  Gene Symbol: IGHD2-15
  Gene Name: immunoglobulin heavy diversity 2-15
  ENSP ID: ENSP00000427969
WW

SEQ ID NO: 212984 - protein, 3 aa, Homo sapiens
  Payload ID: 7946
  Gene Symbol: IGHD2-15
  Gene Name: immunoglobulin heavy diversity 2-15
  ENSP ID: ENSP00000427969
LLL

SEQ ID NO: 212985 - protein, 3 aa, Homo sapiens
  Payload ID: 7946
  Gene Symbol: IGHD2-15
  Gene Name: immunoglobulin heavy diversity 2-15
  ENSP ID: ENSP00000487993
RIL

SEQ ID NO: 212986 - protein, 2 aa, Homo sapiens
  Payload ID: 7946
  Gene Symbol: IGHD2-15
  Gene Name: immunoglobulin heavy diversity 2-15
  ENSP ID: ENSP00000487993
WW

SEQ ID NO: 212987 - protein, 3 aa, Homo sapiens
  Payload ID: 7946
  Gene Symbol: IGHD2-15
  Gene Name: immunoglobulin heavy diversity 2-15
  ENSP ID: ENSP00000487993
LLL

SEQ ID NO: 212988 - protein, 3 aa, Homo sapiens
  Payload ID: 7947
  Gene Symbol: IGHD2-2
  Gene Name: immunoglobulin heavy diversity 2-2
  ENSP ID: ENSP00000430788
RIL

SEQ ID NO: 212989 - protein, 5 aa, Homo sapiens
  Payload ID: 7947
  Gene Symbol: IGHD2-2
  Gene Name: immunoglobulin heavy diversity 2-2
  ENSP ID: ENSP00000430788
YQLLC

SEQ ID NO: 212990 - protein, 3 aa, Homo sapiens
  Payload ID: 7947
  Gene Symbol: IGHD2-2
  Gene Name: immunoglobulin heavy diversity 2-2
  ENSP ID: ENSP00000487604
RIL

SEQ ID NO: 212991 - protein, 5 aa, Homo sapiens
  Payload ID: 7947
  Gene Symbol: IGHD2-2
  Gene Name: immunoglobulin heavy diversity 2-2
  ENSP ID: ENSP00000487604
YQLLC

SEQ ID NO: 212992 - protein, 5 aa, Homo sapiens
  Payload ID: 7948
  Gene Symbol: IGHD2-21
  Gene Name: immunoglobulin heavy diversity 2-21
  ENSP ID: ENSP00000429324
SILWW

SEQ ID NO: 212993 - protein, 3 aa, Homo sapiens
  Payload ID: 7948
  Gene Symbol: IGHD2-21
  Gene Name: immunoglobulin heavy diversity 2-21
  ENSP ID: ENSP00000429324
LLF

SEQ ID NO: 212994 - protein, 5 aa, Homo sapiens
  Payload ID: 7948
  Gene Symbol: IGHD2-21
  Gene Name: immunoglobulin heavy diversity 2-21
  ENSP ID: ENSP00000487599
SILWW

SEQ ID NO: 212995 - protein, 3 aa, Homo sapiens
  Payload ID: 7948
  Gene Symbol: IGHD2-21
  Gene Name: immunoglobulin heavy diversity 2-21
  ENSP ID: ENSP00000487599
LLF

SEQ ID NO: 212996 - protein, 4 aa, Homo sapiens
  Payload ID: 7949
  Gene Symbol: IGHD2-8
  Gene Name: immunoglobulin heavy diversity 2-8
  ENSP ID: ENSP00000428616
RILY

SEQ ID NO: 212997 - protein, 5 aa, Homo sapiens
  Payload ID: 7949
  Gene Symbol: IGHD2-8
  Gene Name: immunoglobulin heavy diversity 2-8
  ENSP ID: ENSP00000428616
WCMLY

SEQ ID NO: 212998 - protein, 4 aa, Homo sapiens
  Payload ID: 7949
  Gene Symbol: IGHD2-8
  Gene Name: immunoglobulin heavy diversity 2-8
  ENSP ID: ENSP00000488083
RILY

SEQ ID NO: 212999 - protein, 5 aa, Homo sapiens
  Payload ID: 7949
  Gene Symbol: IGHD2-8
  Gene Name: immunoglobulin heavy diversity 2-8
  ENSP ID: ENSP00000488083
WCMLY

SEQ ID NO: 213000 - protein, 2 aa, Homo sapiens
  Payload ID: 7950
  Gene Symbol: IGHD3OR15-3A
  Gene Name: immunoglobulin heavy diversity 3/OR15-3A (non-functional)
  ENSP ID: ENSP00000474133
VL

SEQ ID NO: 213001 - protein, 7 aa, Homo sapiens
  Payload ID: 7950
  Gene Symbol: IGHD3OR15-3A
  Gene Name: immunoglobulin heavy diversity 3/OR15-3A (non-functional)
  ENSP ID: ENSP00000474133
FLDWLLY

SEQ ID NO: 213002 - protein, 2 aa, Homo sapiens
  Payload ID: 7951
  Gene Symbol: IGHD3OR15-3B
  Gene Name: immunoglobulin heavy diversity 3/OR15-3B (non-functional)
  ENSP ID: ENSP00000474573
VL

SEQ ID NO: 213003 - protein, 7 aa, Homo sapiens
  Payload ID: 7951
  Gene Symbol: IGHD3OR15-3B
  Gene Name: immunoglobulin heavy diversity 3/OR15-3B (non-functional)
  ENSP ID: ENSP00000474573
FLDWLLY

SEQ ID NO: 213004 - protein, 2 aa, Homo sapiens
  Payload ID: 7953
  Gene Symbol: IGHD3-16
  Gene Name: immunoglobulin heavy diversity 3-16
  ENSP ID: ENSP00000428366
VL

SEQ ID NO: 213005 - protein, 9 aa, Homo sapiens
  Payload ID: 7953
  Gene Symbol: IGHD3-16
  Gene Name: immunoglobulin heavy diversity 3-16
  ENSP ID: ENSP00000428366
LRLGELSLY

SEQ ID NO: 213006 - protein, 2 aa, Homo sapiens
  Payload ID: 7953
  Gene Symbol: IGHD3-16
  Gene Name: immunoglobulin heavy diversity 3-16
  ENSP ID: ENSP00000487787
VL

SEQ ID NO: 213007 - protein, 9 aa, Homo sapiens
  Payload ID: 7953
  Gene Symbol: IGHD3-16
  Gene Name: immunoglobulin heavy diversity 3-16
  ENSP ID: ENSP00000487787
LRLGELSLY

SEQ ID NO: 213008 - protein, 3 aa, Homo sapiens
  Payload ID: 7954
  Gene Symbol: IGHD3-22
  Gene Name: immunoglobulin heavy diversity 3-22
  ENSP ID: ENSP00000429952
VLL

SEQ ID NO: 213009 - protein, 4 aa, Homo sapiens
  Payload ID: 7954
  Gene Symbol: IGHD3-22
  Gene Name: immunoglobulin heavy diversity 3-22
  ENSP ID: ENSP00000429952
WLLL

SEQ ID NO: 213010 - protein, 3 aa, Homo sapiens
  Payload ID: 7954
  Gene Symbol: IGHD3-22
  Gene Name: immunoglobulin heavy diversity 3-22
  ENSP ID: ENSP00000488711
VLL

SEQ ID NO: 213011 - protein, 4 aa, Homo sapiens
  Payload ID: 7954
  Gene Symbol: IGHD3-22
  Gene Name: immunoglobulin heavy diversity 3-22
  ENSP ID: ENSP00000488711
WLLL

SEQ ID NO: 213012 - protein, 3 aa, Homo sapiens
  Payload ID: 7957
  Gene Symbol: IGHD4OR15-4A
  Gene Name: immunoglobulin heavy diversity 4/OR15-4A (non-functional)
  ENSP ID: ENSP00000474693
LWC

SEQ ID NO: 213013 - protein, 1 aa, Homo sapiens
  Payload ID: 7957
  Gene Symbol: IGHD4OR15-4A
  Gene Name: immunoglobulin heavy diversity 4/OR15-4A (non-functional)
  ENSP ID: ENSP00000474693
L

SEQ ID NO: 213014 - protein, 3 aa, Homo sapiens
  Payload ID: 7958
  Gene Symbol: IGHD4OR15-4B
  Gene Name: immunoglobulin heavy diversity 4/OR15-4B (non-functional)
  ENSP ID: ENSP00000475053
LWC

SEQ ID NO: 213015 - protein, 1 aa, Homo sapiens
  Payload ID: 7958
  Gene Symbol: IGHD4OR15-4B
  Gene Name: immunoglobulin heavy diversity 4/OR15-4B (non-functional)
  ENSP ID: ENSP00000475053
L

SEQ ID NO: 213016 - protein, 2 aa, Homo sapiens
  Payload ID: 7959
  Gene Symbol: IGHD4-11
  Gene Name: immunoglobulin heavy diversity 4-11 (non-functional)
  ENSP ID: ENSP00000430034
LQ

SEQ ID NO: 213017 - protein, 1 aa, Homo sapiens
  Payload ID: 7959
  Gene Symbol: IGHD4-11
  Gene Name: immunoglobulin heavy diversity 4-11 (non-functional)
  ENSP ID: ENSP00000430034
L

SEQ ID NO: 213018 - protein, 2 aa, Homo sapiens
  Payload ID: 7959
  Gene Symbol: IGHD4-11
  Gene Name: immunoglobulin heavy diversity 4-11 (non-functional)
  ENSP ID: ENSP00000488735
LQ

SEQ ID NO: 213019 - protein, 1 aa, Homo sapiens
  Payload ID: 7959
  Gene Symbol: IGHD4-11
  Gene Name: immunoglobulin heavy diversity 4-11 (non-functional)
  ENSP ID: ENSP00000488735
L

SEQ ID NO: 213020 - protein, 2 aa, Homo sapiens
  Payload ID: 7960
  Gene Symbol: IGHD4-17
  Gene Name: immunoglobulin heavy diversity 4-17
  ENSP ID: ENSP00000431089
LR

SEQ ID NO: 213021 - protein, 1 aa, Homo sapiens
  Payload ID: 7960
  Gene Symbol: IGHD4-17
  Gene Name: immunoglobulin heavy diversity 4-17
  ENSP ID: ENSP00000431089
L

SEQ ID NO: 213022 - protein, 2 aa, Homo sapiens
  Payload ID: 7960
  Gene Symbol: IGHD4-17
  Gene Name: immunoglobulin heavy diversity 4-17
  ENSP ID: ENSP00000488261
LR

SEQ ID NO: 213023 - protein, 1 aa, Homo sapiens
  Payload ID: 7960
  Gene Symbol: IGHD4-17
  Gene Name: immunoglobulin heavy diversity 4-17
  ENSP ID: ENSP00000488261
L

SEQ ID NO: 213024 - protein, 3 aa, Homo sapiens
  Payload ID: 7961
  Gene Symbol: IGHD4-23
  Gene Name: immunoglobulin heavy diversity 4-23 (non-functional)
  ENSP ID: ENSP00000430248
LRW

SEQ ID NO: 213025 - protein, 1 aa, Homo sapiens
  Payload ID: 7961
  Gene Symbol: IGHD4-23
  Gene Name: immunoglobulin heavy diversity 4-23 (non-functional)
  ENSP ID: ENSP00000430248
L

SEQ ID NO: 213026 - protein, 3 aa, Homo sapiens
  Payload ID: 7961
  Gene Symbol: IGHD4-23
  Gene Name: immunoglobulin heavy diversity 4-23 (non-functional)
  ENSP ID: ENSP00000488168
LRW

SEQ ID NO: 213027 - protein, 1 aa, Homo sapiens
  Payload ID: 7961
  Gene Symbol: IGHD4-23
  Gene Name: immunoglobulin heavy diversity 4-23 (non-functional)
  ENSP ID: ENSP00000488168
L

SEQ ID NO: 213028 - protein, 2 aa, Homo sapiens
  Payload ID: 7962
  Gene Symbol: IGHD4-4
  Gene Name: immunoglobulin heavy diversity 4-4
  ENSP ID: ENSP00000428393
LQ

SEQ ID NO: 213029 - protein, 1 aa, Homo sapiens
  Payload ID: 7962
  Gene Symbol: IGHD4-4
  Gene Name: immunoglobulin heavy diversity 4-4
  ENSP ID: ENSP00000428393
L

SEQ ID NO: 213030 - protein, 2 aa, Homo sapiens
  Payload ID: 7962
  Gene Symbol: IGHD4-4
  Gene Name: immunoglobulin heavy diversity 4-4
  ENSP ID: ENSP00000488889
LQ

SEQ ID NO: 213031 - protein, 1 aa, Homo sapiens
  Payload ID: 7962
  Gene Symbol: IGHD4-4
  Gene Name: immunoglobulin heavy diversity 4-4
  ENSP ID: ENSP00000488889
L

SEQ ID NO: 213032 - protein, 123 aa, Homo sapiens
  Payload ID: 8388
  Gene Symbol: IFNL4
  Gene Name: interferon, lambda 4 (gene/pseudogene)
  ENSP ID: ENSP00000476098
MRPSVWAAVAAGLWVLCTVIAEGPPALPALALPLAGAPDAGGCQGAEGPLRGRGAELGAAQLLLPPQEGSSAAIVLRSAPPRGPGHRGRPGSAQRPAPLGAAPRRRPDPGAAGGRGEGCGGLP

SEQ ID NO: 213033 - protein, 56 aa, Homo sapiens
  Payload ID: 8388
  Gene Symbol: IFNL4
  Gene Name: interferon, lambda 4 (gene/pseudogene)
  ENSP ID: ENSP00000476098
AGTARLLQEGPRGPEEASQTPESGLASVPQSQRGLQPPAPAHVGAPAGCTLWALPL

SEQ ID NO: 213034 - protein, 51 aa, Homo sapiens
  Payload ID: 8388
  Gene Symbol: IFNL4
  Gene Name: interferon, lambda 4 (gene/pseudogene)
  ENSP ID: ENSP00000489240
MRPSVWAAVAAGLWVLCTVIAEGPPALPALALPLAGAPDAGGCQGAEGPLP

SEQ ID NO: 213035 - protein, 56 aa, Homo sapiens; identical to SEQ ID NO: 213033
  Payload ID: 8388
  Gene Symbol: IFNL4
  Gene Name: interferon, lambda 4 (gene/pseudogene)
  ENSP ID: ENSP00000489240

SEQ ID NO: 213036 - protein, 75 aa, Homo sapiens
  Payload ID: 8388
  Gene Symbol: IFNL4
  Gene Name: interferon, lambda 4 (gene/pseudogene)
  ENSP ID: ENSP00000489559
MRPSVWAAVAAGLWVLCTVIAEGPPALPALALPLAGAPDAGGCQGAEGPLRGRGAELGAAQLLLPPQEGSSAAIA

SEQ ID NO: 213037 - protein, 56 aa, Homo sapiens; identical to SEQ ID NO: 213033
  Payload ID: 8388
  Gene Symbol: IFNL4
  Gene Name: interferon, lambda 4 (gene/pseudogene)
  ENSP ID: ENSP00000489559

SEQ ID NO: 213038 - protein, 239 aa, Homo sapiens; identical to SEQ ID NO: 44079
  Payload ID: 8986
  Gene Symbol: KIR2DS4
  Gene Name: killer cell immunoglobulin-like receptor, two domains, short cytoplasmic tail, 4
  ENSP ID: ENSP00000340011

SEQ ID NO: 213039 - protein, 29 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000340011
LGPQWSKSLSPSSSSFSFIAGAPTKKMLL

SEQ ID NO: 213040 - protein, 10 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000340011
WTKSLQGTEQ

SEQ ID NO: 213041 - protein, 16 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000340011
TARILMNKTIRRCHTH

SEQ ID NO: 213042 - protein, 222 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000375609
MSLMVIIMACVGFFLLQGAWPQEGVHRKPSFLALPGHLVKSEETVILQCWSDVMFEHFLLHREGKFNNTLHLIGEHHDGVSKANFSIGPMMPVLAGTYRCYGSVPHSPYQLSAPSDPLDMVIIGLYEKPSLSAQPGPTVQAGENVTLSCSSIYPGKGRPMNVGSLQCAASTEHSRPTFLWALPPTEGPTDASALSVTLPTSGQTRVIHCLFPSQVTPDTYMF

SEQ ID NO: 213043 - protein, 2 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000375609
LG

SEQ ID NO: 213044 - protein, 239 aa, Homo sapiens [sequence omitted]

SEQ ID NO: 213045 - protein, 29 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000478383
LGPQWSKSLSPSSSSFSFIAGAPTKKMLL

SEQ ID NO: 213046 - protein, 10 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000478383
WTKSLQGTEQ

SEQ ID NO: 213047 - protein, 16 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000478383
TARILMNKTIRRCHTH

SEQ ID NO: 213048 - protein, 239 aa, Homo sapiens [sequence omitted]

SEQ ID NO: 213049 - protein, 29 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000478998
LGPQWSKSLSPSSSSFSFIAGAPTKKMLL

SEQ ID NO: 213050 - protein, 10 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000478998
WTKSLQGTEQ

SEQ ID NO: 213051 - protein, 16 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000478998
TARILMNKTIRRCHTH

SEQ ID NO: 213052 - protein, 222 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000479129
MSLMVIIMACVGFFLLQGAWPQEGVHRKPSFLALPGHLVKSEETVILQCWSDVMFEHFLLHREGKFNNTLHLIGEHHDGVSKANFSIGPMMPVLAGTYRCYGSVPHSPYQLSAPSDPLDMVIIGLYEKPSLSAQPGPTVQAGENVTLSCSSIYPGRGRPMNVGSLQCAASTEHSRPTFLWALPPTEGPTDASALSVTLPTSGQTRVIHCLFPSQVTPDTYMF

SEQ ID NO: 213053 - protein, 2 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000479129
LG

SEQ ID NO: 213054 - protein, 239 aa, Homo sapiens [sequence omitted]

SEQ ID NO: 213055 - protein, 29 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000479356
LGPQWSKSLSPSSSSFSFIAGAPTKKMLL

SEQ ID NO: 213056 - protein, 10 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000479356
WTKSLQGTEQ

SEQ ID NO: 213057 - protein, 16 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000479356
TARILMNKTIRRCHTH

SEQ ID NO: 213058 - protein, 239 aa, Homo sapiens; identical to SEQ ID NO: 44079
  Payload ID: 8986
  Gene Symbol: KIR2DS4
  Gene Name: killer cell immunoglobulin-like receptor, two domains, short cytoplasmic tail, 4
  ENSP ID: ENSP00000479369

SEQ ID NO: 213059 - protein, 29 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000479369
LGPQWSKSLSPSSSSFSFIAGAPTKKMLL

SEQ ID NO: 213060 - protein, 10 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000479369
WTKSLQGTEQ

SEQ ID NO: 213061 - protein, 16 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000479369
TARILMNKTIRRCHTH

SEQ ID NO: 213062 - protein, 239 aa, Homo sapiens [sequence omitted]

SEQ ID NO: 213063 - protein, 29 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000479404
LGPQWSKSLSPSSSSFSFIAGAPTKKMLL

SEQ ID NO: 213064 - protein, 10 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000479404
WTKSLQGTEQ

SEQ ID NO: 213065 - protein, 45 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000479404
TARILMNKTIRRCHTHNWITVFSHREKSLALLRGPRHPQQIPACT

SEQ ID NO: 213066 - protein, 47 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000479404
NFQMLSPDPKLSSVHEHHSQALRGSSRETTALSQNRVASSHVPAAGI

SEQ ID NO: 213067 - protein, 239 aa, Homo sapiens [sequence omitted]

SEQ ID NO: 213068 - protein, 29 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000481139
LGPQWSKSLSPSSSSFSFIAGAPTKKMLL

SEQ ID NO: 213069 - protein, 10 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000481139
WTKSLQGTEQ

SEQ ID NO: 213070 - protein, 16 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000481139
TARILMNKTIRRCHTH

SEQ ID NO: 213071 - protein, 239 aa, Homo sapiens [sequence omitted]

SEQ ID NO: 213072 - protein, 29 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000481279
LGPQWSKSLSPSSSSFSFIAGAPTKKMLL

SEQ ID NO: 213073 - protein, 10 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000481279
WTKSLQGTEQ

SEQ ID NO: 213074 - protein, 45 aa, Homo sapiens; identical to SEQ ID NO: 213065
  Payload ID: 8986
  Gene Symbol: KIR2DS4
  Gene Name: killer cell immunoglobulin-like receptor, two domains, short cytoplasmic tail, 4
  ENSP ID: ENSP00000481279

SEQ ID NO: 213075 - protein, 47 aa, Homo sapiens; identical to SEQ ID NO: 213066
  Payload ID: 8986
  Gene Symbol: KIR2DS4
  Gene Name: killer cell immunoglobulin-like receptor, two domains, short cytoplasmic tail, 4
  ENSP ID: ENSP00000481279

SEQ ID NO: 213076 - protein, 239 aa, Homo sapiens; identical to SEQ ID NO: 44079
  Payload ID: 8986
  Gene Symbol: KIR2DS4
  Gene Name: killer cell immunoglobulin-like receptor, two domains, short cytoplasmic tail, 4
  ENSP ID: ENSP00000481428

SEQ ID NO: 213077 - protein, 29 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000481428
LGPQWSKSLSPSSSSFSFIAGAPTKKMLL

SEQ ID NO: 213078 - protein, 10 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000481428
WTKSLQGTEQ

SEQ ID NO: 213079 - protein, 16 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000481428
TARILMNKTIRRCHTH

SEQ ID NO: 213080 - protein, 222 aa, Homo sapiens; identical to SEQ ID NO: 44091
  Payload ID: 8986
  Gene Symbol: KIR2DS4
  Gene Name: killer cell immunoglobulin-like receptor, two domains, short cytoplasmic tail, 4
  ENSP ID: ENSP00000483571

SEQ ID NO: 213081 - protein, 2 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000483571
LG

SEQ ID NO: 213082 - protein, 239 aa, Homo sapiens; identical to SEQ ID NO: 44079
  Payload ID: 8986
  Gene Symbol: KIR2DS4
  Gene Name: killer cell immunoglobulin-like receptor, two domains, short cytoplasmic tail, 4
  ENSP ID: ENSP00000483620

SEQ ID NO: 213083 - protein, 29 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000483620
LGPQWSKSLSPSSSSFSFIAGAPTKKMLL

SEQ ID NO: 213084 - protein, 10 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000483620
WTKSLQGTEQ

SEQ ID NO: 213085 - protein, 16 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000483620
TARILMNKTIRRCHTH

SEQ ID NO: 213086 - protein, 924 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000481139
MDRQCSERPYSCTPTGRVSSAVSQNSRISPPVSTSMKDSSCMKVHQDSARRDRWSHPTTILLHKSQSSQATLMLQEHRMFMGEAYSAATGFKMLQDMNSADPFHLKYIIKKIKNMAHGSPKLVMETIHDYFIDNPEISSRHKFRLFQTLEMVIGASDVLEETWEKTFTRLALENMTKATELEDIYQDAASNMLVAICRHSWRVVAQHLETELLTGVFPHRSLLYVMGVLSSSEELFSQEDKACWEEQLIQMAIKSVPFLSTDVWSKELLWTLTTPSWTQQEQSPEKAFLFTYYGLILQAEKNGATVRRHLQALLETSHQWPKQREGMALTLGLAATRHLDDVWAVLDQFGRSRPIRWSLPSSSPKNSEDLRWKWASSTILLAYGQVAAKARAHILPWVDNIVSRMVFYFHYSSWDETLKQSFLTATLMLMGAVSRSEGAHSYEFFQTSELLQCLMVLMEKEPQDTLCTRSRQQAMHIASSLCKLRPPIDLERKSQLLSTCFRSVFALPLLDALEKHTCLFLEPPNIQLWPVARERAGWTHQGWGPRAVLHCSEHLQSLYSRTMEALDFMLQSLIMQNPTADELHFLLSHLYIWLASEKAHERQRAVHSCMILLKFLNHNGYLDPKEDFKRIGQLVGILGMLCQDPDRATQRCSLEGASHLYQLLMCHKTGEALQAESQAPKELSQAHSDGAPLWNSRDQKATPLGPQEMAKNHIFQLCSFQVIKDIMQQLTLAELSDLIWTAIDGLGSTSPFRVQAASEMLLTAVQEHGAKLEIVSSMAQAIRLRLCSVHIPQAKEKTLHAITLLARSHTCELVATFLNISIPLDSHTFQLWRALGAGQPTSHLVLTTLLACLQERPLPTGASDSSPCPKEKTYLRLLAAMNMLHELQFAREFKQAVQEGYPKLFLALLTQMHYVLELNLPSEP

SEQ ID NO: 213087 - protein, 393 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000481139
PKQQAQEAAVPSPQSCSTSLEALKSLLSTTGHWHDFAHLELQGSWELFTTIHTYPKGVGLLARAMVQNHCRQIPAVLRQLLPSLQSPQERERKVAILILTKFLYSPVLLEVLPKQAALTVLAQGLHDPSPEVRVLSLQGLSNILFHPDKGSLLQGQLRPLLDGFFQSSDQVIVCIMGTVSDTLHRLGAQGTGSQSLGVAISTRSFFNDERDGIRAAAMALFGDLVAAMADRELSGLRTQVHQSMVPLLLHLKDQCPAVATQAKFTFYRCAVLLRWRLLHTLFCTLAWERGLSARHFLWTCLMTRSQEEFSIHLSQALSYLHSHSCHIKTWVTLFIGHTICYHPQAVFQMLNAVDTNLLFRTFEHLRSDPEPSIREFATSQLSFLQKVSARPKQ

SEQ ID NO: 213088 - protein, 99 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000481279
  MOD_RES (1)..(1): Any amino acid
XHTFQLWRALGAGQPTSHLVLTTLLACLQERPLPTGASDSSPCPKEKTYLRLLAAMNMLHELQFAREFKQAVQEGYPKLFLALLTQMHYVLELNLPSEP

SEQ ID NO: 213089 - protein, 393 aa, Homo sapiens; identical to SEQ ID NO: 213087
  Payload ID: 8986
  Gene Symbol: KIR2DS4
  Gene Name: killer cell immunoglobulin-like receptor, two domains, short cytoplasmic tail, 4
  ENSP ID: ENSP00000481279

SEQ ID NO: 213090 - protein, 1978 aa, Homo sapiens
  Payload ID: 10600
  Gene Symbol: MUC6
  Gene Name: mucin 6, oligomeric mucus/gel-forming
  ENSP ID: ENSP00000486295
MVQRWLLLSCCGALLSAGLANTSYTSPGLQRLKDSPQTAPDKGQCSTWGAGHFSTFDHHVYDFSGTCNYIFAATCKDAFPTFSVQLRRGPDGSISRIIVELGASVVTVSEAIISVKDIGVISLPYTSNGLQITPFGQSVRLVAKQLELELEVVWGPDSHLMVLVERKYMGQMCGLCGNFDGKVTNEFVSEEGKFLEPHKFAALQKLDDPGEICTFQDIPSTHVRQAQHARICTQLLTLVAPECSVSKEPFVLSCQADVAAAPQPGPQNSSCATLSEYSRQCSMVGQPVRRWRSPGLCSVGQCPANQVYQECGSACVKTCSNPQHSCSSSCTFGCFCPEGTVLNDLSNNHTCVPVTQCPCVLHGAMYAPGEVTIAACQTCRCTLGRWVCTERPCPGHCSLEGGSFVTTFDARPYRFHGTCTYILLQSPQLPEDGALMAVYDKSGVSHSETSLVAVVYLSRQDKIVISQDEVVTNNGEAKWLPYKTRNITVFRQTSTHLQMATSFGLELVVQLRPIFQAYVTVGPQFRGQTRGLCGNFNGDTTDDFTTSMGIAEGTASLFVDSWRAGNCPAALERETDPCSMSQLNKVCAETHCSMLLRTGTVFERCHATVNPAPFYKRCVYQACNYEETFPHICAALGDYVHACSLRGVLLWGWRSSVDNCTIPCTGNTTFSYNSQACERTCLSLSDRATECHHSAVPVDGCNCPDGTYLNQKGECVRKAQCPCILEGYKFILAEQSTVINGITCHCINGRLSCPQRPQMFLASCQAPKTFKSCSQSSENKFGAACAPTCQMLATGVACVPTKCEPGCVCAEGLYENADGQCVPPEECPCEFSGVSYPGGAELHTDCRTCSCSRGRWACQQGTHCPSTCTLYGEGHVITFDGQRFVFDGNCEYILATDVCGVNDSQPTFKILTENVICGNSGVTCSRAIKIFLGGLSVVLADRNYTVTGEEPHVQLGVTPGALSLVVDISIPGRYNLTLIWNRHMTILIRIARASQDPLCGLCGNFNGNMKDDFETRSRYVASSELELVNSWKESPLCGDVSFVTDPCSLNAFRRSWAERKCSVINSQTFATCHSKVYHLPYYEACVRDACGCDSGGDCECLCDAVAAYAQACLDKGVCVDWRTPAFCPIYCGFYNTHTQDGHGEYQYTQEANCTWHYQPCLCPSQPQSVPGSNIEGCYNCSQDEYFDHEEGVCVPCMPPTTPQPPTTPQLPTTGSRPTQVWPMTGTSTTIGLLSSTGPSPSSNHTPASPTQTPLLPATLTSSKPTASSGEPPRPTTAVTPQATSGLPPTATLRSTATKPTVTQATTRATASTASPATTSTAQSTTRTTMTLPTPATSGTSPTLPKSTNQELPGTTATQTTGPRPTPASTTGPTTPQPGQPTRPTATETTQTRTTTEYTTPQTPHTTHSPPTAGSPVPSTGPVTATSFHATTTYPTPSHPETTLPTHVPPFSTSLVTPSTHTVITPTHAQMATSASNHSAPTGTIPPPTTLKATGSTHTAPPITPTTSGTSQAHSSFSTNKTPTSLHSHTSSTHHPEVTPTSTTTITPNPTSTRTRTPVAHTNSATSSRPPPPFTTHSPPTGSSPFSSTGPMTATSFKTTTTYPTPSLPQTTLLTHVPPFSTSLVTPITHTVITPTHPQMSTSAYIHSTPTGTIAPPTTVKATRSTYTAPLMTATTSRISQAHSSISTAKTSTSLHSHASSTHHPEVTPTSTTNVTPKSTSRGTSTPVTHTTSATSSRPPTPITTHSSPTRSSPLSSTGRMTATSLKTTTTYPTPSQAHITLPIHVPPFSTSSVTPSTHTVITPTHPQMSTSASNHSTSTGTIPPLTTLTTTLHHTLPTYREQSPLSHRSYDSNILQDHHYLSNHITPSDHTSHSRSTFLQLVSDSKYSHSHHPYPCTDVHFCLDPLNANRYHSSTDNAHGHRVHTHSLTNDGDNHSDHPSPQLIQHSQNLYIHPLTCFLHTPSGNHTNFYHQHYSQVH

SEQ ID NO: 213091 - protein, 96 aa, Homo sapiens
  Payload ID: 10600
  Gene Symbol: MUC6
  Gene Name: mucin 6, oligomeric mucus/gel-forming
  ENSP ID: ENSP00000486295
CRNQHPCGPHHLGHQQQATHTLHHTLPTYREQSHLFHRSYDCNIHQDHHDLSNPITPSDHTYHSCSTFLHLISHSKYSHSHHPYPRTDVHFLHTLS

SEQ ID NO: 213092 - protein, 168 aa, Homo sapiens
  Payload ID: 10600
  Gene Symbol: MUC6
  Gene Name: mucin 6, oligomeric mucus/gel-forming
  ENSP ID: ENSP00000486295
SHPNFYHHHHPQPHQYRHQNPCGPHHLGHQQQATHTLHHTFPTYREQSHLFHRSYDCNILSDHHYLSNPITPSDHTSHSPSTFLHLLGDSKYSHSHHHYPHTDGHFCLHPLNANRHRSSTNNAQGHRVHPHSANNDADHQRDEPSPELIQHSQNLYIPTFTNFLHTPS

SEQ ID NO: 213093 - protein, 148 aa, Homo sapiens
  Payload ID: 10600
  Gene Symbol: MUC6
  Gene Name: mucin 6, oligomeric mucus/gel-forming
  ENSP ID: ENSP00000486295
SHPNFYRHHPQSHQYRNRHPCGPHHLSHQQQANHTLHHTLPTYREQSLLFHRSYDCNILPDHHYLSNTITPSDHTSHSRYIFLHLLGDSKYSHSHHPYPRTDGHLCVHPLNANRHHFSTNNAQGHRVLPLSPTNDVDHQWDQPIPKLI

SEQ ID NO: 213094 - protein, 18 aa, Homo sapiens
  Payload ID: 10600
  Gene Symbol: MUC6
  Gene Name: mucin 6, oligomeric mucus/gel-forming
  ENSP ID: ENSP00000486295
HGQNLYIPTFTHFLNTSS

SEQ ID NO: 213095 - protein, 94 aa, Homo sapiens
  Payload ID: 10600
  Gene Symbol: MUC6
  Gene Name: mucin 6, oligomeric mucus/gel-forming
  ENSP ID: ENSP00000486295
SHLNFYHQHHPQPHQYRHQNPCGPHHVGHQQQATHTLHHTLPTYREQSHLFHRSYDCKHPSRPPLPIQPHHTLTPHFPLTFHLSPPPWGLQVLT

SEQ ID NO: 213096 - protein, 40 aa, Homo sapiens
  Payload ID: 10600
  Gene Symbol: MUC6
  Gene Name: mucin 6, oligomeric mucus/gel-forming
  ENSP ID: ENSP00000486295
SSPLPTHRWPLLPPSTQCQQALFLHRPRSRPQGPPTQPHQ

SEQ ID NO: 213097 - protein, 88 aa, Homo sapiens
  Payload ID: 10600
  Gene Symbol: MUC6
  Gene Name: mucin 6, oligomeric mucus/gel-forming
  ENSP ID: ENSP00000486295
RQPPVGPANPQAHLARPKLLHPYIHTFPQHIILKSPQLLPPPSPPTTPVQAPEPLWPTPPRPPAAGYPYPSPHIPHLQGAVPSLPQVL

SEQ ID NO: 213098 - protein, 32 aa, Homo sapiens
  Payload ID: 10600
  Gene Symbol: MUC6
  Gene Name: mucin 6, oligomeric mucus/gel-forming
  ENSP ID: ENSP00000486295
LQHPFRPPLPIQPHHTLTPHFPLTFHLSPPPW

SEQ ID NO: 213099 - protein, 5 aa, Homo sapiens
  Payload ID: 10600
  Gene Symbol: MUC6
  Gene Name: mucin 6, oligomeric mucus/gel-forming
  ENSP ID: ENSP00000486295
LQVLT

SEQ ID NO: 213100 - protein, 40 aa, Homo sapiens; identical to SEQ ID NO: 213096
  Payload ID: 10600
  Gene Symbol: MUC6
  Gene Name: mucin 6, oligomeric mucus/gel-forming
  ENSP ID: ENSP00000486295

SEQ ID NO: 213101 - protein, 1322 aa, Homo sapiens
  Payload ID: 10600
  Gene Symbol: MUC6
  Gene Name: mucin 6, oligomeric mucus/gel-forming
  ENSP ID: ENSP00000486295
RQPPVGPANPQAHLARHWASTSLHSHIPPPTTVKATGTGSTHTAPRMTVTTSGTSQAHSSFSTAKTSTSLHSHASSTLHPEVTPTSTTTITPNPTNTGIRTPVANTTSATSSRLTTPFTTHSPPTGSSPISSTGPMTATSFQTTTTYPTPSHPQTTLPTHVPPFSTSLVTPSTHTVITPTHAQMATSASIHSTPTGTIPPPTTLKATGSTHTAPPMMPTTSGTSQASSSFNTAKTSTSLHSHTSSTHHPEVTPTSITNITLNPTSIGTWTPVAHTTSATSSRLTTPFTTHSPPTGTTPISSTGPVTATSFHATTTYPTPSHPQTTLPTHVPSFSTSLVTPSTHIVITPTHAQMATSASIHSMQTGTIPPPTTIKATGSTHTAPPMTPTTSGTSQSLSSFSTAKTSTSLPYHTSSTHHPEVTPTSTTNITPKHTSTGTRTPVAHTTSATSSRLPTPFTTHSPPTGSSPISSTGPMTAPSFQTTTTYPTPSHPQTTLPTHVPPFSTSLVTPSTHTVITPTHAQMATSASIHSMPTGTIPPPTTLKATGSTHTAPTMTPTTSGTSQALSSLNTAKTSTSLHSHTSSTHHAEATSTSTTNITPNPTSTGTPPMTVTTSGTSQSRSSFSTAKTSTSLHSHTSSTHHPEVTSTSTTSITPNHTSTGTRTPVAHTTSATSSRLPTPFTTHSPPTGTTPISSTGPVTATSFQTTTTYPTPSHPHTTLPTHVPSFSTSLVTPSTHTVIIPTHTQMATSASIHSMPTGTIPPPTTIKATGSTHTAPPMTPTTSGTSQSPSSFSTAKTSTSLPYHTSSTHHPEVTPTSTTNITPKHTSTGTRTPVAHTTSASSSRLPTPFTTHSPPTGSSPFSSTGPMTATSFQTTTTYPTPSHPQTTLPTHVPPFSTSLVTPSTHTVIITTHTQMATSASIHSTPTGTVPPPTTLKATGSTHTAPPMTVTTSGTSQTHSSFSTATASSSFISSSSWLPQNSSSRPPSSPITTQLPHLSSATTPVSTTNQLSSSFSPSPSAPSTVSSYVPSSHSSPQTSSPSVGTSSSFVSAPVHSTTLSSGSHSSLSTHPTTASVSASPLFPSSPAASTTIRATLPHTISSPFTLSALLPISTVTVSPTPSSHLASSTIAFPSTPRTTASTHTAPAFSSQSTTSRSTSLTTRVPTSGFVSLTSGVTGIPTSPVTNLTTRHPGPTLSPTTRFLTSSLTAHGSTPASAPVSSLGTPTPTSPGVCSVREQQEEITFKGCMANVTVTRCEGACISAASFNIITQQVDARCSCCRPLHSYEQQLELPCPDPSTPGRRLVLTLQVFSHCVCSSVACGD

SEQ ID NO: 213102 - protein, 2382 aa, Homo sapiens
  Payload ID: 10600
  Gene Symbol: MUC6
  Gene Name: mucin 6, oligomeric mucus/gel-forming
  ENSP ID: ENSP00000487059
MVQRWLLLSCCGALLSAGLANTSYTSPGLQRLKDSPQTAPDKGQCSTWGAGHFSTFDHHVYDFSGTCNYIFAATCKDAFPTFSVQLRRGPDGSISRIIVELGASVVTVSEAIISVKDIGVISLPYTSNGLQITPFGQSVRLVAKQLELELEVVWGPDSHLMVLVERKYMGQMCGLCGNFDGKVTNEFVSEEGKFLEPHKFAALQKLDDPGEICTFQDIPSTHVRQAQHARICTQLLTLVAPECSVSKEPFVLSCQADVAAAPQPGPQNSSCATLSEYSRQCSMVGQPVRRWRSPGLCSVGQCPANQVYQECGSACVKTCSNPQHSCSSSCTFGCFCPEGTVLNDLSNNHTCVPVTQCPCVLHGAMYAPGEVTIAACQTCRCTLGRWVCTERPCPGHCSLEGGSFVTTFDARPYRFHGTCTYILLQSPQLPEDGALMAVYDKSGVSHSETSLVAVVYLSRQDKIVISQDEVVTNNGEAKWLPYKTRNITVFRQTSTHLQMATSFGLELVVQLRPIFQAYVTVGPQFRGQTRGLCGNFNGDTTDDFTTSMGIAEGTASLFVDSWRAGNCPAALERETDPCSMSQLNKVCAETHCSMLLRTGTVFERCHATVNPAPFYKRCMYQACNYEETFPHICAALGDYVHACSLRGVLLWGWRSSVDNCTIPCTGNTTFSYNSQACERTCLSLSDRATECHHSAVPVDGCNCPDGTYLNQKGECVRKAQCPCILEGYKFILAEQSTVINGITCHCINGRLSCPQRPQMFLASCQAPKTFKSCSQSSENKFGAACAPTCQMLATGVACVPTKCEPGCVCAEGLYENADGQCVPPEECPCEFSGVSYPGGAELHTDCRTCSCSRGRWACQQGTHCPSTCTLYGEGHVITFDGQRFVFDGNCEYILATDVCGVNDSQPTFKILTENVICGNSGVTCSRAIKIFLGGLSVVLADRNYTVTGEEPHVQLGVTPGALSLVVDISIPGRYNLTLIWNRHMTILIRIARASQDPLCGLCGNFNGNMKDDFETRSRYVASSELELVNSWKESPLCGDVSFVTDPCSLNAFRRSWAERKCSVINSQTFATCHSKVYHLPYYEACVRDACGCDSGGDCECLCDAVAAYAQACLDKGVCVDWRTPAFCPIYCGFYNTHTQDGHGEYQYTQEANCTWHYQPCLCPSQPQSVPGSNIEGCYNCSQDEYFDHEEGVCVPCMPPTTPQPPTTPQLPTTGSRPTQVWPMTGTSTTIGLLSSTGPSPSSNHTPASPTQTPLLPATLTSSKPTASSGEPPRPTTAVTPQATSGLPPTATLRSTATKPTVTQATTRATASTASPATTSTAQSTTRTTMTLPTPATSGTSPTLPKSTNQELPGTTATQTTGPRPTPASTTGPTTPQPGQPTRPTATETTQTRTTTEYTTPQTPHTTHSPPTAGSPVPSTGPVTATSFHATTTYPTPSHPETTLPTHVPPFSTSLVTPSTHTVITPTHAQMATSASIHSAPTGTIPPPTTLKATGSTHTAPPITPTTSGTSQAHSSFSTNKTPTSLHSHTSSTHHPEVTPTSTTTITPNPTSTRTRTPVAHTNSATSSRPPPPFTTHSPPTGSSPFSSTGPMTATSFKTTTTYPTPSLPQTTLLTHVPPFSTSLVTPITHTVITPTHPQMSTSAYIHSTPTGTIAPPTTVKATRSTYTAPLMTATTSRISQAHSSISTAKTSTSLHSHASSTHHPEVTPTSTTNVTPKSTSRGTSTPVTHTTSATSSRPPTPITTHSSPTRSSPLSSTGRMTATSLKTTTTYPTPSQAHITLPIHVPPFSTSSVTPSTHTVITPTHPQMSTSASNHSTSTGTIPPLTTLMATGSTHTAPLITVTTSRTSQVHSSFSTAKTSTSLLSHASSTHHPEITTNSTTTITPNPTSTGTGTPVAHTTSATSSRPPPPFTTHSPPTESSPLSPTGPMTPTSFKTTTTYPTTSHPQTTLPTHVPPFSSSSVTPSTHTVITPTHAQMSTSASIHSTPTGTIPPLTTLTATGSTHTASPMTGTTIRTTQAHSSFSIAKTSTSILSHASSTHHPETTPTSTTNITPKSTSAGTSTPVAHTTLATSSRPPTPFTTHSPPTGSSPISSTGPMTATSIKTTTTYPTPSHPQTTLTTHVPPFSTSSVTPSTHTVITPTHAQMSTSASIHSTPTGTVPPLTTRMPTGSTHTGPPMTGTIIQTSKAHNSFSTAKTSTSLHSHASSTHHPETTPTSTTNITPKPTSAGTSTPVAHTTLATSSRLPTTFTTHFPSTGSSPVSSTGPMTATSSQTTTTYPTPSHPQTTLPTHIPPFSTSLVTPSTHTVITPTRAQMSTSASIHSTPTGTIPPPTTLKATGTTHTHTTRTMTVTTTSQALRSLYIGTASTSIPLHSHASSHLRT

SEQ ID NO: 213103 - protein, 5 aa, Homo sapiens
  Payload ID: 10600
  Gene Symbol: MUC6
  Gene Name: mucin 6, oligomeric mucus/gel-forming
  ENSP ID: ENSP00000487059
RHFYY

SEQ ID NO: 213104 - protein, 29 aa, Homo sapiens
  Payload ID: 10600
  Gene Symbol: MUC6
  Gene Name: mucin 6, oligomeric mucus/gel-forming
  ENSP ID: ENSP00000487059
HHHHPQPHQYRNPTNDSDHQWDQPIPKLI

SEQ ID NO: 213105 - protein, 18 aa, Homo sapiens
  Payload ID: 10600
  Gene Symbol: MUC6
  Gene Name: mucin 6, oligomeric mucus/gel-forming
  ENSP ID: ENSP00000487059
HGQNLYIPTFTHFLHTPS

SEQ ID NO: 213106 - protein, 149 aa, Homo sapiens
  Payload ID: 10600
  Gene Symbol: MUC6
  Gene Name: mucin 6, oligomeric mucus/gel-forming
  ENSP ID: ENSP00000487059
SHLNFYHQHHPQPHQYRHQNPCGPHHVGHQQQATHTLHHTLPTYRDHSHLFHRSCHCNILPDHHYRSNPITPSHHTSHSRSIFLHLLGDSKYSHSHHPYPRTDGHFCLHPLNANRHYSSTDHDQGHRVHPHSPTNDGNHQWDQPIPKLI

SEQ ID NO: 213107 - protein, 18 aa, Homo sapiens
  Payload ID: 10600
  Gene Symbol: MUC6
  Gene Name: mucin 6, oligomeric mucus/gel-forming
  ENSP ID: ENSP00000487059
HGQNFYIPTFTHFLNTSS

SEQ ID NO: 213108 - protein, 168 aa, Homo sapiens
  Payload ID: 10600
  Gene Symbol: MUC6
  Gene Name: mucin 6, oligomeric mucus/gel-forming
  ENSP ID: ENSP00000487059
SHPNFYHHHHPQPHQYRHQNPCGPHHLGHQQQATHTLHHTFPTYREQSHLFHRSYDCNILSDHHYLSNPITPSDHTSHSHSTFLHLLGDSKYSHSHHHYPHTDGHFCLHPLNANRHRSSTNNAQGHRVHPHSANNDADHQRDEPSPELIQHSQNLYIPTFTNFLHTPS

SEQ ID NO: 213109 - protein, 167 aa, Homo sapiens
  Payload ID: 10600
  Gene Symbol: MUC6
  Gene Name: mucin 6, oligomeric mucus/gel-forming
  ENSP ID: ENSP00000487059
SHPNFYRHHPQSHQSRNRHPCGPHHLSHQQQANHTLHHTLLTYREQSLLFHRSYDCNILPDHHYLSNPITPSDHTSHSRSTFLHLFGDSKYSHSHHPYPCTDGHFCLHPLNANRHDSSTDNAQGHRVHPHSANNDADHQRDQPSPELIKHSQNLYIPTFTHFLHTPC

SEQ ID NO: 213110 - protein, 527 aa, Homo sapiens
  Payload ID: 10600
  Gene Symbol: MUC6
  Gene Name: mucin 6, oligomeric mucus/gel-forming
  ENSP ID: ENSP00000487059
SHLNFYHQHHPQPHQYRNWGACGPHHLSHQQQANPALHHTLPTYRVTTLKATGSIHTAPPMTPTTSGTSQSPSSFSMAKTSTSLPYHTSSTHHPEVTPTSTTNITPKHTSTGTRTPVAHTTSATSSKLPTPFTTHSPPTGSSPISSTGPVTATSFQTTTTYPTPSHSHTTLPTHVPPSSTSLVTPNTHTVITHTHAQMSTSASIHSTPTGTIPPPTTLKATGSTHTAPPMTPTTSGTRQAPSSFSTAKTSTSLHSHTSSTHHPAVTPTSTTTITPNHTSTGTRTPVAHTTSATSSRLPTPFTTHSPPTGSSPISSTAPCHCNILPDHHYPIQPTSQSQYHTSHSHSTFLHLLGDSKYTHSHHPNFYHHHPQSHQYRNRHPCGPHHLSHQQQANHTLHHTLPTYREQSHLFHRSCHCNILPCHHYLSNTITPSDHTSHSRSIFLHLLGDSKYSHSHHPYPRTDDHFCLHPLNANRHHSSTDNAEGHRVHPHSPTNDANHQWDQPSLKLIQHSQNLYIPTFTHFLHTPS

SEQ ID NO: 213111 - protein, 149 aa, Homo sapiens
  Payload ID: 10600
  Gene Symbol: MUC6
  Gene Name: mucin 6, oligomeric mucus/gel-forming
  ENSP ID: ENSP00000487059
SHPNFYHQHHPQPHQYRNLDTRGPHHLSHQQQANHTLHHTLPTYRDHSHLFHRSCHCNILPCHHYLSNTITPSDHTSHSRSIFLHLLGDSKYSHSHHPYPRTDGHFCLHPLNANRHHSSTDHDQGHRVHPHSPTNDTDHQWDQPIPKLI

SEQ ID NO: 213112 - protein, 18 aa, Homo sapiens
  Payload ID: 10600
  Gene Symbol: MUC6
  Gene Name: mucin 6, oligomeric mucus/gel-forming
  ENSP ID: ENSP00000487059
HGQNFYIPTLPHFLHTPS

SEQ ID NO: 213113 - protein, 149 aa, Homo sapiens
  Payload ID: 10600
  Gene Symbol: MUC6
  Gene Name: mucin 6, oligomeric mucus/gel-forming
  ENSP ID: ENSP00000487059
SHPNFYHQHHPQTHQYRHQNPCGPHHLGHQQQTTHTLHHTFPTYREQSHLFHRSYDCTILSDHHYLSNPITPSDHTSHSHSTFLHLLGDSKYSQGHHPYPCTDVHFCLHPLNANRHHSSTNNAQGHRVHPHSPTNHSDHQWDQPIRKLI

SEQ ID NO: 213114 - protein, 18 aa, Homo sapiens
  Payload ID: 10600
  Gene Symbol: MUC6
  Gene Name: mucin 6, oligomeric mucus/gel-forming
  ENSP ID: ENSP00000487059
HRQNLYILTFTHFLHTLS

SEQ ID NO: 213115 - protein, 168 aa, Homo sapiens
  Payload ID: 10600
  Gene Symbol: MUC6
  Gene Name: mucin 6, oligomeric mucus/gel-forming
  ENSP ID: ENSP00000487059
SHPNFYHHHHPQPHQYRHQNPCGPHHLGHQQQATHTLHHTFPTYREQSHLFHRSYDCNILPDHHYLSNPITPSDHTSHSRSTFLHLFGDSKYSHSHHPYPCTDGHFCLHPLNANRHDSSTDNAQGHRVHPHSANNDADHQRDQPSPELIKHSQNLYIPTFTHFLHTPC

SEQ ID NO: 213116 - protein, 35 aa, Homo sapiens
  Payload ID: 10600
  Gene Symbol: MUC6
  Gene Name: mucin 6, oligomeric mucus/gel-forming
  ENSP ID: ENSP00000487059
SHLNFYHQHHPQPHQYRNPTNDSDHQWDQPIPKLI

SEQ ID NO: 213117 - protein, 18 aa, Homo sapiens
  Payload ID: 10600
  Gene Symbol: MUC6
  Gene Name: mucin 6, oligomeric mucus/gel-forming
  ENSP ID: ENSP00000487059
HGQNLYIPTFTHFLHTPS

SEQ ID NO: 213118 - protein, 149 aa, Homo sapiens
  Payload ID: 10600
  Gene Symbol: MUC6
  Gene Name: mucin 6, oligomeric mucus/gel-forming
  ENSP ID: ENSP00000487059
SHLNFYHQHHPQPHQYRHQNPCGPHHVGHQQQATHTLHHTLPTYRDHSHLFHRSCHCNILPDHHYLSNPITPSHHTSHSRSIFLHLLGDSKYSHGHHPYPHTDGHFCLHPLNANRHHSSTDHDQGHRVHPHSPTNDTDHQWDQPIPKLI

SEQ ID NO: 213119 - protein, 18 aa, Homo sapiens
  Payload ID: 10600
  Gene Symbol: MUC6
  Gene Name: mucin 6, oligomeric mucus/gel-forming
  ENSP ID: ENSP00000487059
HGQNFYIPTLPHFLNTPS

SEQ ID NO: 213120 - protein, 169 aa, Homo sapiens
  Payload ID: 10600
  Gene Symbol: MUC6
  Gene Name: mucin 6, oligomeric mucus/gel-forming
  ENSP ID: ENSP00000487059
SHPNFYHQHHPQTHQYRHQNPCGPHHLGQQQQATHTLHHTLPTYREQSLLFHRSYDCNILPDHHYLSNPITPSDHTSHSRSTFLHLLGDSKYSHSHHHYPHTDGHFCLHPLNANRHRSSTNNAQGHRVHPHSPTNDSDHQWDQPNPQLIQHSYSLFFLHILLVLAASEL

SEQ ID NO: 213121 - protein, 25 aa, Homo sapiens
  Payload ID: 10600
  Gene Symbol: MUC6
  Gene Name: mucin 6, oligomeric mucus/gel-forming
  ENSP ID: ENSP00000487059
LKATVITYHHTTPPLEFCNHSCFHN

SEQ ID NO: 213122 - protein, 83 aa, Homo sapiens
  Payload ID: 10600
  Gene Symbol: MUC6
  Gene Name: mucin 6, oligomeric mucus/gel-forming
  ENSP ID: ENSP00000487059
SAVLLIFSQSFCPLYCFFLCALLPLLSPDFIAFCWHIFLFRVRPRALHNPELGVTLLIVHSSHDCISVCISSFSFFSSCLYYH

SEQ ID NO: 213123 - protein, 163 aa, Homo sapiens
  Payload ID: 10600
  Gene Symbol: MUC6
  Gene Name: mucin 6, oligomeric mucus/gel-forming
  ENSP ID: ENSP00000487059
GHSPPHYLLSFHPLCSTPHIHCYRVSHPIQPPSLQHHCISVHAQDHGQHPHRPCLLLSVHHLAVHFSHHPSSHIRLCVTHLGGDGYPHLSSHQPYHQAPWSHLVAYHTVPDQLPHCPWKHPCFCPGIFSRDTYAHLTRGLQCAGAAGGDHVQGVHGERDGNPL

SEQ ID NO: 213124 - protein, 29 aa, Homo sapiens
  Payload ID: 10600
  Gene Symbol: MUC6
  Gene Name: mucin 6, oligomeric mucus/gel-forming
  ENSP ID: ENSP00000487059
GRLHFRCQLQHHHPAGGCPLQLLPPPPLL

SEQ ID NO: 213125 - protein, 37 aa, Homo sapiens
  Payload ID: 10600
  Gene Symbol: MUC6
  Gene Name: mucin 6, oligomeric mucus/gel-forming
  ENSP ID: ENSP00000487059
AAAGAALPRSQHAWPAARTHPAGVQPLRVQLCGLWRL

SEQ ID NO: 213126 - protein, 15 aa, Homo sapiens
  Payload ID: 10843
  Gene Symbol: NAT8B
  Gene Name: N-acetyltransferase 8B (GCN5-related, putative, gene/pseudogene)
  ENSP ID: ENSP00000485054
MAPYHIRKYQESDRK

SEQ ID NO: 213127 - protein, 151 aa, Homo sapiens
  Payload ID: 10843
  Gene Symbol: NAT8B
  Gene Name: N-acetyltransferase 8B (GCN5-related, putative, gene/pseudogene)
  ENSP ID: ENSP00000485054
VVGLLSRGMAEHAPATFRRLLKLPRTLILLLGGALALLLVSGSWILALVFSLSLLPALWFLAKKPWTRYVDIALRTDMSDITKSYLSECGSCFWVGESEEKVVGTVGALPVDDPTLREKRLQLFHLSVDNEHRGQGIAKALVRTVLQFARD

SEQ ID NO: 213128 - protein, 58 aa, Homo sapiens
  Payload ID: 10843
  Gene Symbol: NAT8B
  Gene Name: N-acetyltransferase 8B (GCN5-related, putative, gene/pseudogene)
  ENSP ID: ENSP00000485054
GYSEVVLDTSNIQLSAMGLYQSLGFKKTGQSFFHVWARLVDLHTVHFIYHLPSAQAGR

SEQ ID NO: 213129 - protein, 124 aa, Homo sapiens [sequence omitted]

SEQ ID NO: 213130 - protein, 201 aa, Homo sapiens
  Payload ID: 10844
  Gene Symbol: NAT8L
  Gene Name: N-acetyltransferase 8-like (GCN5-related, putative)
  ENSP ID: ENSP00000328464
PLRGHLPPVALRGRGDPRAVRATGSGLLPQGTGGVRGAHGGHLPPAFLRLPPAAALLLRHHGAAAPGLHAELRRRAASAGRLPGAAAAALGAHPGLLWRHRRRPAPPALPQRPGQGRLHLRLAPGSHLPALRLRHLHVRAAQGQLLPAPGPHPGAGLHQRHAAAVPTHLQPAQPRDHRRPEQGAGAPAARPSSRRGSARAL

SEQ ID NO: 213131 - protein, 213 aa, Homo sapiens
  Payload ID: 11662
  Gene Symbol: OR10J4
  Gene Name: olfactory receptor, family 10, subfamily J, member 4 (gene/pseudogene)
  ENSP ID: ENSP00000475611
MPRPNFMAVTEFTFEGFSIFEWHHRLILFVIFLVLYVLTLASNAIILIVIRLNHQLHTPMYFFLSVLSISETYYTVAINPQMLSGLLSPQQTISIPGCAAQLFFYLTFGVNKCFLLTAMGYDHYVAICNPLQYSVIMGKKACIQLVSGSWNIGLSTAIIQVSSVFSLPFCDANLISHFFCDIRPIMKLACADTTIKELLLCSSVSVSLFCPWY

SEQ ID NO: 213132 - protein, 6 aa, Homo sapiens
  Payload ID: 11662
  Gene Symbol: OR10J4
  Gene Name: olfactory receptor, family 10, subfamily J, member 4 (gene/pseudogene)
  ENSP ID: ENSP00000475611
SSSPMS

SEQ ID NO: 213133 - protein, 39 aa, Homo sapiens
  Payload ID: 11662
  Gene Symbol: OR10J4
  Gene Name: olfactory receptor, family 10, subfamily J, member 4 (gene/pseudogene)
  ENSP ID: ENSP00000475611
LSPPSSRLHQLRAGERPLLLVPHTSQWSLSTMAVLLSST

SEQ ID NO: 213134 - protein, 14 aa, Homo sapiens
  Payload ID: 11662
  Gene Symbol: OR10J4
  Gene Name: olfactory receptor, family 10, subfamily J, member 4 (gene/pseudogene)
  ENSP ID: ENSP00000475611
NPNPKIPCRTDLSL

SEQ ID NO: 213135 - protein, 8 aa, Homo sapiens
  Payload ID: 11662
  Gene Symbol: OR10J4
  Gene Name: olfactory receptor, family 10, subfamily J, member 4 (gene/pseudogene)
  ENSP ID: ENSP00000475611
HTLLLLLC

SEQ ID NO: 213136 - protein, 6 aa, Homo sapiens
  Payload ID: 11662
  Gene Symbol: OR10J4
  Gene Name: olfactory receptor, family 10, subfamily J, member 4 (gene/pseudogene)
  ENSP ID: ENSP00000475611
TLLYTA

SEQ ID NO: 213137 - protein, 19 aa, Homo sapiens
  Payload ID: 11662
  Gene Symbol: OR10J4
  Gene Name: olfactory receptor, family 10, subfamily J, member 4 (gene/pseudogene)
  ENSP ID: ENSP00000475611
GTKRSRMPCSELWAESLSL

SEQ ID NO: 213138 - protein, 226 aa, Homo sapiens
  Payload ID: 11682
  Gene Symbol: OR11H7
  Gene Name: olfactory receptor, family 11, subfamily H, member 7 (gene/pseudogene)
  ENSP ID: ENSP00000451021
MNNSQISTVTQFVLLGFPGPWKIQIIFFSMILLVYIFTLTGNMAIICAVRWDHRLHTPMYVLLANFSFLEIWYVTCTVPNMLVNFFSKTKTISFSGCFTQFHFFFSLGTTECFFLCVMAYDRYLAICHPLHYPSIMTGQLCGILVSLCWLIGFLGHSISIFFIFQLPFCGPNIIDHFLCDVDPLMALSSAPTHIIGHVFHSVSSLFINLTMVYILGSYTLVLRTVL

SEQ ID NO: 213139 - protein, 86 aa, Homo sapiens
  Payload ID: 11682
  Gene Symbol: OR11H7
  Gene Name: olfactory receptor, family 11, subfamily H, member 7 (gene/pseudogene)
  ENSP ID: ENSP00000451021
VPSSAGWQKAISTCGSHLVVVSLFYGAIMLMYVSPTPGNSVAMHKLITLIYSVVTPVLNPLIYSLRNKDMKYALHHVFCGMRIIQR

SEQ ID NO: 213140 - protein, 238 aa, Homo sapiens; identical to SEQ ID NO: 59571
  Payload ID: 11684
  Gene Symbol: OR12D1
  Gene Name: olfactory receptor, family 12, subfamily D, member 1 (gene/pseudogene)
  ENSP ID: ENSP00000475351

SEQ ID NO: 213141 - protein, 1 aa, Homo sapiens
  Payload ID: 11684
  Gene Symbol: OR12D1
  Gene Name: olfactory receptor, family 12, subfamily D, member 1 (gene/pseudogene)
  ENSP ID: ENSP00000475351
W

SEQ ID NO: 213142 - protein, 37 aa, Homo sapiens
  Payload ID: 11684
  Gene Symbol: OR12D1
  Gene Name: olfactory receptor, family 12, subfamily D, member 1 (gene/pseudogene)
  ENSP ID: ENSP00000475351
LFFCMHLFSSPIFIMPQGPPWTRTGSLPSCILWSLQY

SEQ ID NO: 213143 - protein, 2 aa, Homo sapiens
  Payload ID: 11684
  Gene Symbol: OR12D1
  Gene Name: olfactory receptor, family 12, subfamily D, member 1 (gene/pseudogene)
  ENSP ID: ENSP00000475351
TH

SEQ ID NO: 213144 - protein, 3 aa, Homo sapiens
  Payload ID: 11684
  Gene Symbol: OR12D1
  Gene Name: olfactory receptor, family 12, subfamily D, member 1 (gene/pseudogene)
  ENSP ID: ENSP00000475351
STL

SEQ ID NO: 213145 - protein, 4 aa, Homo sapiens
  Payload ID: 11684
  Gene Symbol: OR12D1
  Gene Name: olfactory receptor, family 12, subfamily D, member 1 (gene/pseudogene)
  ENSP ID: ENSP00000475351
GTRK

SEQ ID NO: 213146 - protein, 7 aa, Homo sapiens
  Payload ID: 11684
  Gene Symbol: OR12D1
  Gene Name: olfactory receptor, family 12, subfamily D, member 1 (gene/pseudogene)
  ENSP ID: ENSP00000475351
KGPLIEQ

SEQ ID NO: 213147 - protein, 9 aa, Homo sapiens
  Payload ID: 11684
  Gene Symbol: OR12D1
  Gene Name: olfactory receptor, family 12, subfamily D, member 1 (gene/pseudogene)
  ENSP ID: ENSP00000475351
KGGFGLKKS

SEQ ID NO: 213148 - protein, 6 aa, Homo sapiens
  Payload ID: 11684
  Gene Symbol: OR12D1
  Gene Name: olfactory receptor, family 12, subfamily D, member 1 (gene/pseudogene)
  ENSP ID: ENSP00000475351
RTLLKH

SEQ ID NO: 213149 - protein, 151 aa, Homo sapiens
  Payload ID: 11692
  Gene Symbol: OR13C7
  Gene Name: olfactory receptor, family 13, subfamily C, member 7 (gene/pseudogene)
  ENSP ID: ENSP00000477333
MVSANQTASVTEFILLGLSAHPKLEKTFFVLILLMYLVILLGNGVLILMTVSNSHLHMPMYFFLGNLSFLDICYTTSSVPLILDSFLTPRKTISFSACAVQMFLSFAMGATECVLLSMMAFDRYVAICNPLRYPVVMSKAAYMPIRLPAPG

SEQ ID NO: 213150 - protein, 13 aa, Homo sapiens
  Payload ID: 11692
  Gene Symbol: OR13C7
  Gene Name: olfactory receptor, family 13, subfamily C, member 7 (gene/pseudogene)
  ENSP ID: ENSP00000477333
LEALLPWCRHPLQ

SEQ ID NO: 213151 - protein, 20 aa, Homo sapiens
  Payload ID: 11692
  Gene Symbol: OR13C7
  Gene Name: olfactory receptor, family 13, subfamily C, member 7 (gene/pseudogene)
  ENSP ID: ENSP00000477333
GCPSVETTSSTTSPVRFWLS

SEQ ID NO: 213152 - protein, 10 aa, Homo sapiens
  Payload ID: 11692
  Gene Symbol: OR13C7
  Gene Name: olfactory receptor, family 13, subfamily C, member 7 (gene/pseudogene)
  ENSP ID: ENSP00000477333
SWPVLISLSM

SEQ ID NO: 213153 - protein, 4 aa, Homo sapiens
  Payload ID: 11692
  Gene Symbol: OR13C7
  Gene Name: olfactory receptor, family 13, subfamily C, member 7 (gene/pseudogene)
  ENSP ID: ENSP00000477333
SVWE

SEQ ID NO: 213154 - protein, 2 aa, Homo sapiens
  Payload ID: 11692
  Gene Symbol: OR13C7
  Gene Name: olfactory receptor, family 13, subfamily C, member 7 (gene/pseudogene)
  ENSP ID: ENSP00000477333
PM

SEQ ID NO: 213155 - protein, 21 aa, Homo sapiens
  Payload ID: 11692
  Gene Symbol: OR13C7
  Gene Name: olfactory receptor, family 13, subfamily C, member 7 (gene/pseudogene)
  ENSP ID: ENSP00000477333
SSWGSRFCSSLSPMSSSLPPS

SEQ ID NO: 213156 - protein, 60 aa, Homo sapiens
  Payload ID: 11692
  Gene Symbol: OR13C7
  Gene Name: olfactory receptor, family 13, subfamily C, member 7 (gene/pseudogene)
  ENSP ID: ENSP00000477333
GSPQLRGGKRPSPPALPTSQSWSSSMGPSSSCMGSPSLRTRWGQTSKTLQTNSFPFSMGW

SEQ ID NO: 213157 - protein, 10 aa, Homo sapiens
  Payload ID: 11692
  Gene Symbol: OR13C7
  Gene Name: olfactory receptor, family 13, subfamily C, member 7 (gene/pseudogene)
  ENSP ID: ENSP00000477333
PPCSTPSSTA

SEQ ID NO: 213158 - protein, 4 aa, Homo sapiens
  Payload ID: 11692
  Gene Symbol: OR13C7
  Gene Name: olfactory receptor, family 13, subfamily C, member 7 (gene/pseudogene)
  ENSP ID: ENSP00000477333
GTRM

SEQ ID NO: 213159 - protein, 3 aa, Homo sapiens
  Payload ID: 11692
  Gene Symbol: OR13C7
  Gene Name: olfactory receptor, family 13, subfamily C, member 7 (gene/pseudogene)
  ENSP ID: ENSP00000477333
RLL

SEQ ID NO: 213160 - protein, 2 aa, Homo sapiens
  Payload ID: 11692
  Gene Symbol: OR13C7
  Gene Name: olfactory receptor, family 13, subfamily C, member 7 (gene/pseudogene)
  ENSP ID: ENSP00000477333
GT

SEQ ID NO: 213161 - protein, 7 aa, Homo sapiens
  Payload ID: 11692
  Gene Symbol: OR13C7
  Gene Name: olfactory receptor, family 13, subfamily C, member 7 (gene/pseudogene)
  ENSP ID: ENSP00000477333
YFRNALP

SEQ ID NO: 213162 - protein, 135 aa, Homo sapiens [sequence omitted]

SEQ ID NO: 213163 - protein, 179 aa, Homo sapiens
  Payload ID: 11781
  Gene Symbol: OR4A8
  Gene Name: olfactory receptor, family 4, subfamily A, member 8 (gene/pseudogene)
  ENSP ID: ENSP00000476467
QVCILLLVVAVTGGFLHSVFQILVVYSLPFCGPNVIYHFFCNIYPLLDLECTDTYFVGLAVVFNGGAICMVIFTLLLISYGVILNSLKTYSPEGRHKAPFICSSHFIMVILFFVPCIFLYVRPVSNFPIDKFLTVFYSVITPKLNPFIYMLRNSEMRNAIENLLGYQSGKTGFRCSKLN

SEQ ID NO: 213164 - protein, 180 aa, Homo sapiens [sequence omitted]

SEQ ID NO: 213165 - protein, 10 aa, Homo sapiens
  Payload ID: 11823
  Gene Symbol: OR4Q2
  Gene Name: olfactory receptor, family 4, subfamily Q, member 2 (gene/pseudogene)
  ENSP ID: ENSP00000438013
CSPCHQTCLC

SEQ ID NO: 213166 - protein, 4 aa, Homo sapiens
  Payload ID: 11823
  Gene Symbol: OR4Q2
  Gene Name: olfactory receptor, family 4, subfamily Q, member 2 (gene/pseudogene)
  ENSP ID: ENSP00000438013
HFCH

SEQ ID NO: 213167 - protein, 5 aa, Homo sapiens
  Payload ID: 11823
  Gene Symbol: OR4Q2
  Gene Name: olfactory receptor, family 4, subfamily Q, member 2 (gene/pseudogene)
  ENSP ID: ENSP00000438013
IAHGI

SEQ ID NO: 213168 - protein, 111 aa, Homo sapiens
  Payload ID: 11823
  Gene Symbol: OR4Q2
  Gene Name: olfactory receptor, family 4, subfamily Q, member 2 (gene/pseudogene)
  ENSP ID: ENSP00000438013
QWVDLHHLLCGADFLLHHYPSQDSLQGRKAKGTLHVCLSPHGGNTVFWTLYFHLRSSFLYIFCGQDGVCTLQCYYPNAKPPHLHTSEQRGKVSHAEALGQKWAYLEKAGDM

SEQ ID NO: 213169 - protein, 95 aa, Homo sapiens [sequence omitted]

SEQ ID NO: 213170 - protein, 24 aa, Homo sapiens
  Payload ID: 11831
  Gene Symbol: OR5AC1
  Gene Name: olfactory receptor, family 5, subfamily AC, member 1 (gene/pseudogene)
  ENSP ID: ENSP00000475160
VCHPVLLFWFQCNHRMLPAGSDGL

SEQ ID NO: 213171 - protein, 17 aa, Homo sapiens
  Payload ID: 11831
  Gene Symbol: OR5AC1
  Gene Name: olfactory receptor, family 5, subfamily AC, member 1 (gene/pseudogene)
  ENSP ID: ENSP00000475160
PLCSHMQSLALSSGDVQ

SEQ ID NO: 213172 - protein, 25 aa, Homo sapiens
  Payload ID: 11831
  Gene Symbol: OR5AC1
  Gene Name: olfactory receptor, family 5, subfamily AC, member 1 (gene/pseudogene)
  ENSP ID: ENSP00000475160
PLYSVYRYFIFYWFSAFSDSCGFVI

SEQ ID NO: 213173 - protein, 14 aa, Homo sapiens
  Payload ID: 11831
  Gene Symbol: OR5AC1
  Gene Name: olfactory receptor, family 5, subfamily AC, member 1 (gene/pseudogene)
  ENSP ID: ENSP00000475160
INFLQVQYYTLFLL

SEQ ID NO: 213174 - protein, 14 aa, Homo sapiens
  Payload ID: 11831
  Gene Symbol: OR5AC1
  Gene Name: olfactory receptor, family 5, subfamily AC, member 1 (gene/pseudogene)
  ENSP ID: ENSP00000475160
NFTAVQNFLHQSYS

SEQ ID NO: 213175 - protein, 35 aa, Homo sapiens
  Payload ID: 11831
  Gene Symbol: OR5AC1
  Gene Name: olfactory receptor, family 5, subfamily AC, member 1 (gene/pseudogene)
  ENSP ID: ENSP00000475160
YTSDFHLFSIYTSLHFYDSYRLLLLYSLCHPEKEV

SEQ ID NO: 213176 - protein, 2 aa, Homo sapiens
  Payload ID: 11831
  Gene Symbol: OR5AC1
  Gene Name: olfactory receptor, family 5, subfamily AC, member 1 (gene/pseudogene)
  ENSP ID: ENSP00000475160
EG

SEQ ID NO: 213177 - protein, 28 aa, Homo sapiens
  Payload ID: 11831
  Gene Symbol: OR5AC1
  Gene Name: olfactory receptor, family 5, subfamily AC, member 1 (gene/pseudogene)
  ENSP ID: ENSP00000475160
KQSLLYLQCPSALCLFVLRHPLLHVCEF

SEQ ID NO: 213178 - protein, 45 aa, Homo sapiens
  Payload ID: 11831
  Gene Symbol: OR5AC1
  Gene Name: olfactory receptor, family 5, subfamily AC, member 1 (gene/pseudogene)
  ENSP ID: ENSP00000475160
VWISCRSGQNVFFILHNNNSFTKSFYLQPKEQRGYRCPEKNHEEI

SEQ ID NO: 213179 - protein, 141 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000477337
NQTVVTEFLLLGLTDHPYQKIVLFFMFLFVYLITLGGNLGMITLIWIDPRLHTPMYFFLRHLSFVDICSSSSVVPKMLCNIFAEKKDITFLGCAAQMWFFGLFEAAECFLWLPWHMTGMWPSASPCCIRSLCLSRSVCSWW

SEQ ID NO: 213180 - protein, 7 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000477337
GLMPWLL

SEQ ID NO: 213181 - protein, 2 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000477337
AP

SEQ ID NO: 213182 - protein, 29 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000477337
LIQFSLFAYPFVVQILSITFSVIFFHCFP

SEQ ID NO: 213183 - protein, 6 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000477337
HVQTPG

SEQ ID NO: 213184 - protein, 11 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000477337
INLCCLSWLEL

SEQ ID NO: 213185 - protein, 5 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000477337
EYSVV

SEQ ID NO: 213186 - protein, 9 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000477337
SSWSPIFAS

SEQ ID NO: 213187 - protein, 2 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000477337
PS

SEQ ID NO: 213188 - protein, 30 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000477337
RSRLLMGSKKLSSPVFLTLRLSPSCMGLFS

SEQ ID NO: 213189 - protein, 15 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000477337
FMFGQVQVPPWVSIK

SEQ ID NO: 213190 - protein, 7 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000477337
FLYFILW

SEQ ID NO: 213191 - protein, 10 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000477337
SPWLTPLFTA

SEQ ID NO: 213192 - protein, 4 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000477337
GIRR

SEQ ID NO: 213193 - protein, 14 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000477337
KMHSEEKLRGKNLL

SEQ ID NO: 213194 - protein, 1 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000477337
V

SEQ ID NO: 213195 - protein, 145 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000485881
MEDKNQTVVTEFLLLGLTDHPYQKIVLFFMFLFVYLITLGGNLGMITLIWIDPRLHTPMYFFLRHLSFVDICSSSSVVPKMLCNIFAEKKDITFLGCAAQMWFFGLFEAAECFLWLPWHMTGMWPSASPCCIRSLCLSRSVCSWW

SEQ ID NO: 213196 - protein, 7 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000485881
GLMPWLL

SEQ ID NO: 213197 - protein, 2 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000485881
AP

SEQ ID NO: 213198 - protein, 29 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000485881
LIQFSLFAYPFVVQILSITFSVIFFHCFP

SEQ ID NO: 213199 - protein, 6 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000485881
HVQTPG

SEQ ID NO: 213200 - protein, 11 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000485881
INLCCLSWLEL

SEQ ID NO: 213201 - protein, 5 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000485881
EYSVV

SEQ ID NO: 213202 - protein, 9 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000485881
SSWSPIFAS

SEQ ID NO: 213203 - protein, 2 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000485881
PS

SEQ ID NO: 213204 - protein, 30 aa, Homo sapiens; identical to SEQ ID NO: 213188
  Payload ID: 11850
  Gene Symbol: OR5G3
  Gene Name: olfactory receptor, family 5, subfamily G, member 3 (gene/pseudogene)
  ENSP ID: ENSP00000485881

SEQ ID NO: 213205 - protein, 15 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000485881
FMFGQVQVPPWVSIK

SEQ ID NO: 213206 - protein, 7 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000485881
FLYFILW

SEQ ID NO: 213207 - protein, 10 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000485881
SPWLTPLFTA

SEQ ID NO: 213208 - protein, 4 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000485881
GIRR

SEQ ID NO: 213209 - protein, 14 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000485881
KMHSEEKLRGKNLL

SEQ ID NO: 213210 - protein, 268 aa, Homo sapiens [sequence omitted]

SEQ ID NO: 213211 - protein, 25 aa, Homo sapiens
  Payload ID: 11856
  Gene Symbol: OR5H8
  Gene Name: olfactory receptor, family 5, subfamily H, member 8 (gene/pseudogene)
  ENSP ID: ENSP00000476186
SRYGGVSILHCHNSFLKSHYLQPEK

SEQ ID NO: 213212 - protein, 15 aa, Homo sapiens
  Payload ID: 11856
  Gene Symbol: OR5H8
  Gene Name: olfactory receptor, family 5, subfamily H, member 8 (gene/pseudogene)
  ENSP ID: ENSP00000476186
ASHRFTDKNIKRKCL

SEQ ID NO: 213213 - protein, 63 aa, Homo sapiens [sequence omitted]

SEQ ID NO: 213214 - protein, 251 aa, Homo sapiens
  Payload ID: 11992
  Gene Symbol: OR8J2
  Gene Name: olfactory receptor, family 8, subfamily J, member 2 (gene/pseudogene)
  ENSP ID: ENSP00000477259
HLAIINLCNSTVVAPKMLVNFLVTKKTISYYGCAAQLGGFLVFIVAEIFTLAAMAYDRYVAIWSPLLYAVVVSPKVCRLLVSLTYLQSLITALTVSSCVFSVSYCSSNIINHFYCDDVPLLALSCSDTYIPETAVFIFSGTNLLFSMIVVLISYFNIVITILRIRSSEGRQKAFSTCASHMIAVVVFYGTLLFMYLQPRSNHSLDTDKMASVFYTLVIPVLNPLIYSLRNKNVKDALKRFLDNPCRSLKLM

SEQ ID NO: 213215 - protein, 63 aa, Homo sapiens [sequence omitted]

SEQ ID NO: 213216 - protein, 251 aa, Homo sapiens; identical to SEQ ID NO: 213214
  Payload ID: 11992
  Gene Symbol: OR8J2
  Gene Name: olfactory receptor, family 8, subfamily J, member 2 (gene/pseudogene)
  ENSP ID: ENSP00000485975

SEQ ID NO: 213217 - protein, 278 aa, Homo sapiens [sequence omitted]

SEQ ID NO: 213218 - protein, 8 aa, Homo sapiens
  Payload ID: 12053
  Gene Symbol:
  Gene Name: OR52E1
  ENSP ID: ENSP00000476576
SFHLLSTL

SEQ ID NO: 213219 - protein, 13 aa, Homo sapiens
  Payload ID: 12053
  Gene Symbol:
  Gene Name: OR52E1
  ENSP ID: ENSP00000476576
FMVSEPNRLEHKC

SEQ ID NO: 213220 - protein, 6 aa, Homo sapiens
  Payload ID: 12053
  Gene Symbol:
  Gene Name: OR52E1
  ENSP ID: ENSP00000476576
KCFSIN

SEQ ID NO: 213221 - protein, 157 aa, Homo sapiens [sequence omitted]

SEQ ID NO: 213222 - protein, 3 aa, Homo sapiens
  Payload ID: 12054
  Gene Symbol:
  Gene Name: OR5AL1
  ENSP ID: ENSP00000477393
TDC

SEQ ID NO: 213223 - protein, 22 aa, Homo sapiens
  Payload ID: 12054
  Gene Symbol:
  Gene Name: OR5AL1
  ENSP ID: ENSP00000477393
HVCVWIHCGTCTDSGDILLVFL

SEQ ID NO: 213224 - protein, 9 aa, Homo sapiens
  Payload ID: 12054
  Gene Symbol:
  Gene Name: OR5AL1
  ENSP ID: ENSP00000477393
FQRDQPLLP

SEQ ID NO: 213225 - protein, 9 aa, Homo sapiens
  Payload ID: 12054
  Gene Symbol:
  Gene Name: OR5AL1
  ENSP ID: ENSP00000477393
CSISGSGLF

SEQ ID NO: 213226 - protein, 40 aa, Homo sapiens
  Payload ID: 12054
  Gene Symbol:
  Gene Name: OR5AL1
  ENSP ID: ENSP00000477393
HSCQRADVVNHCWVQYSLLSSNCADFLWFHFLCHPEDTFC

SEQ ID NO: 213227 - protein, 39 aa, Homo sapiens
  Payload ID: 12054
  Gene Symbol:
  Gene Name: OR5AL1
  ENSP ID: ENSP00000477393
RETESIFYQCFPSDLHHNILWNNHFYVPAAQVKPFPEYG

SEQ ID NO: 213228 - protein, 5 aa, Homo sapiens
  Payload ID: 12054
  Gene Symbol:
  Gene Name: OR5AL1
  ENSP ID: ENSP00000477393
SCFCV

SEQ ID NO: 213229 - protein, 12 aa, Homo sapiens
  Payload ID: 12054
  Gene Symbol:
  Gene Name: OR5AL1
  ENSP ID: ENSP00000477393
CGSDSYIKPTDL

SEQ ID NO: 213230 - protein, 22 aa, Homo sapiens
  Payload ID: 12054
  Gene Symbol:
  Gene Name: OR5AL1
  ENSP ID: ENSP00000477393
FKKSGGKKCTKENYRKVMFGCQ

SEQ ID NO: 213231 - protein, 356 aa, Homo sapiens
  Payload ID: 12208
  Gene Symbol: PNLIPRP2
  Gene Name: pancreatic lipase-related protein 2
  ENSP ID: ENSP00000463502
MLPPWTLGLLLLATVRGKEVCYGQLGCFSDEKPWAGTLQRPVKLLPWSPEDIDTRFLLYTNENPNNFQLITGTEPDTIEASNFQLDRKTRFIIHGFLDKAEDSWPSDMCKKMFEVEKVNCICVDWRHGSRAMYTQAVQNIRVVGAETAFLIQALSTQLGYSLEDVHVIGHSLGAHTAAEAGRRLGGRVGRITGLDPAGPCFQDEPEEVRLDPSDAVFVDVIHTDSSPIVPSLGFGMSQKVGHLDFFPNGGKEMPGCKKNVLSTITDIDGIWEGIGGFVSCNHLRSFEYYSSSVLNPDGFLGYPCASYDEFQESKCFPCPAEGCPKMGHYADQFKGKTSAVEQTFFLNTGESGNFTS

SEQ ID NO: 213232 - protein, 112 aa, Homo sapiens
  Payload ID: 12208
  Gene Symbol: PNLIPRP2
  Gene Name: pancreatic lipase-related protein 2
  ENSP ID: ENSP00000463502
RYKISVTLSGKEKVNGYIRIALYGSNENSKQYEIFKGSLKPDASHTCAIDVDFNVGKIQKVKFLWNKRGINLSEPKLGASQITVQSGEDGTEYNFCSSDTVEENVLQSLYPC

SEQ ID NO: 213233 - protein, 2130 aa, Homo sapiens
  Payload ID: 12914
  Gene Symbol: PKD1L2
  Gene Name: polycystic kidney disease 1-like 2 (gene/pseudogene)
  ENSP ID: ENSP00000434417
MSAVGLVLLVLALRLRATTVKPEEGSFCSNSQVAFRDACYEFVPLGRTFRDAQSWCEGQGGHLVFIQDEGTQWFLQKHISQDREWWIGLTWNLARNGTTEGPGTWLDTSNVTYSNWHGGQAAAAPDTCGHIGRGPSSEWVTSDCAQTFAFMCEFRVGQSLACEGLNATVHCGLGQVIQVQDAVYGRQNPHFCTQDAGRPSDLEQGCSWANVKEEVAGQCQELQSCQVAADETYFGNLCPTQGSYLWVQYQCREALQLMVSSESFIFDNVTISLTWLLSPYIGNLSCIISTGDSHTFDPYNPPSVSSNVTHQFTSPGEFTVFAECTTSEWHVTAQRQVTVRDKMETLSVTACSGLSQSGAGPLCQAVFGDPLWIQVELDGGTGVTYTVLLGDITLAESTTQKGSLPYNLILDRETQKLMGPGRHRLEIQATGNTTTSTISRNITVHLVELLSGLQASWASDHLELGQDLLITISLAQGTPEELTFEVAGLNATFSHEQVSFGEPFGICRLAVPVEGTFLVTMLVRNAFSNLSLEIGNITITAPSGLQEPSGMNAEGKSKDKGDMEVYIQPGPYVDPFTTVTLGWPDNDKELRFQWSCGSCWALWSSCVERQLLRTDQRELVVPASCLPPPDSAVTLRLAVLRGQELENRAEQCLYVSAPWELRPRVSCERNCRPVNASKDILLRVTMGEDSPVAMFSWYLDNTPTEQAEPLLDACRLRGFWPRSLTLLQSNTSTLLLNSSFLQSRGEVIRIRATALTRHAYGEDTYVISTVPPREVPACTIAPEEGTVLTSFAIFCNASTALGPLEFCFCLESGSCLHCGPEPALPSVYLPLGEENNDFVLTVVISATNRAGDTQQTQAMAKVALGDTCVEDVAFQAAVSEKIPTALQGEGGPEQLLQLAKAVSSMLNQEHESQGSGQSLSIDVRQKVREHVLGSLSAVTTGLEDVQRVQELAEVLREVTCRSKELTPSAQWEASLALQHASEALLTVSAKARPEDQRRQAATRDLFQAVGSVLEASLSNRPEEPAEASSSQIATVLRLLRVMEHVQTTLLLGKLPGGLPAMLATPSISVYTNRIQPWSWQGSSLRPDAADSATFMLPAASSLSSLEGGQEPVDIKIMSFPKSPFPARSHFDVSGTVGGLRVTSPSGQLIPVKNLSENIEILLPRHSQRHSQPTVLNLTSPEALWVNVTSGEATLGIQLHWRPDIALTLSLGYGYHPNKSSYDAQTHLVPMVAPDELPTWILSPQDLRFGEGVYYLTVVPESDLEPAPGRDLTVGITTFLSHCVFWDEVQETWDDSGCQVGPRTSPYQTHCLCNHLTFFGSTFLVMSNAINIHQTAELFATFEDNPVVVTTVGCLCVVYVLVVIWARRKDAQDQAKVKVTVLEDNDPFAQYHYLVTVYTGHRRGAATSSKVTVTLYGLDGEREPHHLADPDTPVFERGAVDAFLLSTLFPLGELRSLRLWHDNSGDRPSWYVSRVLVYDLVMDRKWYFLCNSWLSINVGDCVLDKVFPVATEQDRKQFSHLFFMKTSAGFQDGHIWYSIFSRCARSSFTRVQRVSCCFSLLLCTMLTSIMFWGVPKDPAEQKMDLGKIEFTWQEVMIGLESSILMFPINLLIVQIFQNTRPRVAKEQNTGKWDRGSPNLTPSPQPMEDGLLTPEAVTKDVSRIVSSLFKALKVPSPALGWDSVNLMDINSLLALVEDVIYPQNTSGQVFWEEAKKREDPVTLTLGSSEMKEKSQCPKPKAARSGPWKDSAYRQCLYLQLEHVEQELRLVGPRGFSQPHSHAQALRQLQTLKGGLGVQPGTWAPAHASALQVSKPPQGLPWWCILVGWLLVAATSGVAAFFTMLYGLHYGRASSLRWLISMAVSFVESMFVTQPLKVLGFAAFFALVLKRVDDEEDTVAPLPGHLLGPDPYALFRARRNSSRDVYQPPLTAAIEKMKTTHLKEQKAFALIREILAYLGFLWMLLLVAYGQRDPSAYHLNRHLQHSFTRGFSGVLGFREFFKWANTTLVSNLYGHPPGFITDGNSKLVGSAQIRQVRVQESSCPLAQQPQAYLNGCRAPYSLDAEDMADYGEGWNATTLSNGSTRARTNVKGIPSGANSLCTGEEATWSPWGLIAKARQEFSAISLTTPGWTP

SEQ ID NO: 213234 - protein, 22 aa, Homo sapiens
  Payload ID: 12914
  Gene Symbol: PKD1L2
  Gene Name: polycystic kidney disease 1-like 2 (gene/pseudogene)
  ENSP ID: ENSP00000434417
PELCLWSPLSTTPTSTCSALSR

SEQ ID NO: 213235 - protein, 1 aa, Homo sapiens
  Payload ID: 12914
  Gene Symbol: PKD1L2
  Gene Name: polycystic kidney disease 1-like 2 (gene/pseudogene)
  ENSP ID: ENSP00000434417
R

SEQ ID NO: 213236 - protein, 30 aa, Homo sapiens
  Payload ID: 12914
  Gene Symbol: PKD1L2
  Gene Name: polycystic kidney disease 1-like 2 (gene/pseudogene)
  ENSP ID: ENSP00000434417
RPALWAPFLRTRPCRASACTPSPTAGTPSW

SEQ ID NO: 213237 - protein, 20 aa, Homo sapiens
  Payload ID: 12914
  Gene Symbol: PKD1L2
  Gene Name: polycystic kidney disease 1-like 2 (gene/pseudogene)
  ENSP ID: ENSP00000434417
RQSSSTSSSSSTTWWCRASA

SEQ ID NO: 213238 - protein, 30 aa, Homo sapiens
  Payload ID: 12914
  Gene Symbol: PKD1L2
  Gene Name: polycystic kidney disease 1-like 2 (gene/pseudogene)
  ENSP ID: ENSP00000434417
VKRRGAISAASGTFWSWPSSWPAGAPWRCL

SEQ ID NO: 213239 - protein, 45 aa, Homo sapiens
  Payload ID: 12914
  Gene Symbol: PKD1L2
  Gene Name: polycystic kidney disease 1-like 2 (gene/pseudogene)
  ENSP ID: ENSP00000434417
RGLSWPKGTSSAAGTTGRKASASVRQQQPMPPLATSLPSWYSCPQ

SEQ ID NO: 213240 - protein, 7 aa, Homo sapiens
  Payload ID: 12914
  Gene Symbol: PKD1L2
  Gene Name: polycystic kidney disease 1-like 2 (gene/pseudogene)
  ENSP ID: ENSP00000434417
SFGICSG

SEQ ID NO: 213241 - protein, 3 aa, Homo sapiens
  Payload ID: 12914
  Gene Symbol: PKD1L2
  Gene Name: polycystic kidney disease 1-like 2 (gene/pseudogene)
  ENSP ID: ENSP00000434417
IPK

SEQ ID NO: 213242 - protein, 1 aa, Homo sapiens
  Payload ID: 12914
  Gene Symbol: PKD1L2
  Gene Name: polycystic kidney disease 1-like 2 (gene/pseudogene)
  ENSP ID: ENSP00000434417
T

SEQ ID NO: 213243 - protein, 15 aa, Homo sapiens
  Payload ID: 12914
  Gene Symbol: PKD1L2
  Gene Name: polycystic kidney disease 1-like 2 (gene/pseudogene)
  ENSP ID: ENSP00000434417
SRQPYAVPGATFQAL

SEQ ID NO: 213244 - protein, 15 aa, Homo sapiens
  Payload ID: 12914
  Gene Symbol: PKD1L2
  Gene Name: polycystic kidney disease 1-like 2 (gene/pseudogene)
  ENSP ID: ENSP00000434417
LSSLPCSWLTPSRQT

SEQ ID NO: 213245 - protein, 50 aa, Homo sapiens
  Payload ID: 12914
  Gene Symbol: PKD1L2
  Gene Name: polycystic kidney disease 1-like 2 (gene/pseudogene)
  ENSP ID: ENSP00000434417
YLVGNSVPTKPSLMRRRRWSAFSWESSTTRRSWTIAQCLAPSSLDPALFL

SEQ ID NO: 213246 - protein, 4 aa, Homo sapiens
  Payload ID: 12914
  Gene Symbol: PKD1L2
  Gene Name: polycystic kidney disease 1-like 2 (gene/pseudogene)
  ENSP ID: ENSP00000434417
HLWC

SEQ ID NO: 213247 - protein, 26 aa, Homo sapiens
  Payload ID: 12914
  Gene Symbol: PKD1L2
  Gene Name: polycystic kidney disease 1-like 2 (gene/pseudogene)
  ENSP ID: ENSP00000434417
TCLSLSSWWPSVRSKNTISCRRKGRS

SEQ ID NO: 213248 - protein, 3 aa, Homo sapiens
  Payload ID: 12914
  Gene Symbol: PKD1L2
  Gene Name: polycystic kidney disease 1-like 2 (gene/pseudogene)
  ENSP ID: ENSP00000434417
ICC

SEQ ID NO: 213249 - protein, 40 aa, Homo sapiens
  Payload ID: 12914
  Gene Symbol: PKD1L2
  Gene Name: polycystic kidney disease 1-like 2 (gene/pseudogene)
  ENSP ID: ENSP00000434417
KYSVSWALSLRERSLEAAGSSLGLCPRLATLDQHKLCPRT

SEQ ID NO: 213250 - protein, 1445 aa, Homo sapiens
  Payload ID: 12914
  Gene Symbol: PKD1L2
  Gene Name: polycystic kidney disease 1-like 2 (gene/pseudogene)
  ENSP ID: ENSP00000434644
MGEDSPVAMFSWYLDNTPTEQAEPLLDACRLRGFWPRSLTLLQSNTSTLLLNSSFLQSRGEVIRIRATALTRHAYGEDTYVISTVPPREVPACTIAPEEGTVLTSFAIFCNASTALGPLEFCFCLESGSCLHCGPEPALPSVYLPLGEENNDFVLTVVISATNRAGDTQQTQAMAKVALGDTCVEDVAFQAAVSEKIPTALQGEGGPEQLLQLAKAVSSMLNQEHESQGSGQSLSIDVRQKVREHVLGSLSAVTTGLEDVQRVQELAEVLREVTCRSKELTPSAQWEASLALQHASEALLTVSAKARPEDQRRQAATRDLFQAVGSVLEASLSNRPEEPAEASSSQIATVLRLLRVMEHVQTTLLLGKLPGGLPAMLATPSISVYTNRIQPWSWQGSSLRPDAADSATFMLPAASSLSSLEGGQEPVDIKIMSFPKSPFPARSHFDVSGTVGGLRVTSPSGQLIPVKNLSENIEILLPRHSQRHSQPTVLNLTSPEALWVNVTSGEATLGIQLHWRPDIALTLSLGYGYHPNKSSYDAQTHLVPMVAPDELPTWILSPQDLRFGEGVYYLTVVPESDLEPAPGRDLTVGITTFLSHCVFWDEVQETWDDSGCQVGPRTSPYQTHCLCNHLTFFGSTFLVMSNAINIHQTAELFATFEDNPVVVTTVGCLCVVYVLVVIWARRKDAQDQAKVKVTVLEDNDPFAQYHYLVTVYTGHRRGAATSSKVTVTLYGLDGEREPHHLADPDTPVFERGAVDAFLLSTLFPLGELRSLRLWHDNSGDRPSWYVSRVLVYDLVMDRKWYFLCNSWLSINVGDCVLDKVFPVATEQDRKQFSHLFFMKTSAGFQDGHIWYSIFSRCARSSFTRVQRVSCCFSLLLCTMLTSIMFWGVPKDPAEQKMDLGKIEFTWQEVMIGLESSILMFPINLLIVQIFQNTRPRVAKEQNTGKWDRGSPNLTPSPQPMEDGLLTPEAVTKDVSRIVSSLFKALKVPSPALGWDSVNLMDINSLLALVEDVIYPQNTSGQVFWEEAKKREDPVTLTLGSSEMKEKSQCPKPKAARSGPWKDSAYRQCLYLQLEHVEQELRLVGPRGFSQPHSHAQALRQLQTLKGGLGVQPGTWAPAHASALQVSKPPQGLPWWCILVGWLLVAATSGVAAFFTMLYGLHYGRASSLRWLISMAVSFVESMFVTQPLKVLGFAAFFALVLKRVDDEEDTVAPLPGHLLGPDPYALFRARRNSSRDVYQPPLTAAIEKMKTTHLKEQKAFALIREILAYLGFLWMLLLVAYGQRDPSAYHLNRHLQHSFTRGFSGVLGFREFFKWANTTLVSNLYGHPPGFITDGNSKLVGSAQIRQVRVQESSCPLAQQPQAYLNGCRAPYSLDAEDMADYGEGWNATTLSNGSTRARTNVKGIPSGANSLCTGEEATWSPWGLIAKARQEFSAISLTTPGWTP

SEQ ID NO: 213251 - protein, 22 aa, Homo sapiens
  Payload ID: 12914
  Gene Symbol: PKD1L2
  Gene Name: polycystic kidney disease 1-like 2 (gene/pseudogene)
  ENSP ID: ENSP00000434644
PELCLWSPLSTTPTSTCSALSR

SEQ ID NO: 213252 - protein, 1 aa, Homo sapiens
  Payload ID: 12914
  Gene Symbol: PKD1L2
  Gene Name: polycystic kidney disease 1-like 2 (gene/pseudogene)
  ENSP ID: ENSP00000434644
R

SEQ ID NO: 213253 - protein, 30 aa, Homo sapiens; identical to SEQ ID NO: 213236
  Payload ID: 12914
  Gene Symbol: PKD1L2
  Gene Name: polycystic kidney disease 1-like 2 (gene/pseudogene)
  ENSP ID: ENSP00000434644

SEQ ID NO: 213254 - protein, 20 aa, Homo sapiens
  Payload ID: 12914
  Gene Symbol: PKD1L2
  Gene Name: polycystic kidney disease 1-like 2 (gene/pseudogene)
  ENSP ID: ENSP00000434644
RQSSSTSSSSSTTWWCRASA

SEQ ID NO: 213255 - protein, 30 aa, Homo sapiens; identical to SEQ ID NO: 213238
  Payload ID: 12914
  Gene Symbol: PKD1L2
  Gene Name: polycystic kidney disease 1-like 2 (gene/pseudogene)
  ENSP ID: ENSP00000434644

SEQ ID NO: 213256 - protein, 45 aa, Homo sapiens; identical to SEQ ID NO: 213239
  Payload ID: 12914
  Gene Symbol: PKD1L2
  Gene Name: polycystic kidney disease 1-like 2 (gene/pseudogene)
  ENSP ID: ENSP00000434644

SEQ ID NO: 213257 - protein, 7 aa, Homo sapiens
  Payload ID: 12914
  Gene Symbol: PKD1L2
  Gene Name: polycystic kidney disease 1-like 2 (gene/pseudogene)
  ENSP ID: ENSP00000434644
SFGICSG

SEQ ID NO: 213258 - protein, 3 aa, Homo sapiens
  Payload ID: 12914
  Gene Symbol: PKD1L2
  Gene Name: polycystic kidney disease 1-like 2 (gene/pseudogene)
  ENSP ID: ENSP00000434644
IPK

SEQ ID NO: 213259 - protein, 1 aa, Homo sapiens
  Payload ID: 12914
  Gene Symbol: PKD1L2
  Gene Name: polycystic kidney disease 1-like 2 (gene/pseudogene)
  ENSP ID: ENSP00000434644
T

SEQ ID NO: 213260 - protein, 15 aa, Homo sapiens
  Payload ID: 12914
  Gene Symbol: PKD1L2
  Gene Name: polycystic kidney disease 1-like 2 (gene/pseudogene)
  ENSP ID: ENSP00000434644
SRQPYAVPGATFQAL

SEQ ID NO: 213261 - protein, 15 aa, Homo sapiens
  Payload ID: 12914
  Gene Symbol: PKD1L2
  Gene Name: polycystic kidney disease 1-like 2 (gene/pseudogene)
  ENSP ID: ENSP00000434644
LSSLPCSWLTPSRQT

SEQ ID NO: 213262 - protein, 50 aa, Homo sapiens; identical to SEQ ID NO: 213245
  Payload ID: 12914
  Gene Symbol: PKD1L2
  Gene Name: polycystic kidney disease 1-like 2 (gene/pseudogene)
  ENSP ID: ENSP00000434644

SEQ ID NO: 213263 - protein, 4 aa, Homo sapiens
  Payload ID: 12914
  Gene Symbol: PKD1L2
  Gene Name: polycystic kidney disease 1-like 2 (gene/pseudogene)
  ENSP ID: ENSP00000434644
HLWC

SEQ ID NO: 213264 - protein, 26 aa, Homo sapiens
  Payload ID: 12914
  Gene Symbol: PKD1L2
  Gene Name: polycystic kidney disease 1-like 2 (gene/pseudogene)
  ENSP ID: ENSP00000434644
TCLSLSSWWPSVRSKNTISCRRKGRS

SEQ ID NO: 213265 - protein, 3 aa, Homo sapiens
  Payload ID: 12914
  Gene Symbol: PKD1L2
  Gene Name: polycystic kidney disease 1-like 2 (gene/pseudogene)
  ENSP ID: ENSP00000434644
ICC

SEQ ID NO: 213266 - protein, 40 aa, Homo sapiens; identical to SEQ ID NO: 213249
  Payload ID: 12914
  Gene Symbol: PKD1L2
  Gene Name: polycystic kidney disease 1-like 2 (gene/pseudogene)
  ENSP ID: ENSP00000434644

SEQ ID NO: 213267 - protein, 1 aa, Homo sapiens
  Payload ID: 17160
  Gene Symbol: TRAJ58
  Gene Name: T cell receptor alpha joining 58 (non-functional)
  ENSP ID: ENSP00000452150
  MOD_RES (1)..(1): Any amino acid
X

SEQ ID NO: 213268 - protein, 19 aa, Homo sapiens
  Payload ID: 17160
  Gene Symbol: TRAJ58
  Gene Name: T cell receptor alpha joining 58 (non-functional)
  ENSP ID: ENSP00000452150
ETSGSRLTFGEGTQLTVNP

SEQ ID NO: 213269 - protein, 88 aa, Homo sapiens [sequence omitted]

SEQ ID NO: 213270 - protein, 64 aa, Homo sapiens
  Payload ID: 18982
  Gene Name: ubiquitin-conjugating enzyme E2N-like (gene/pseudogene)
  ENSP ID: ENSP00000488314
DILKDKWSPALQIRTVLLSIQALLNAPNPDDPLANDVVEQWKTNEAQAIETARAWTRLYAMNSI

SEQ ID NO: 213271 - protein, 20 aa, Homo sapiens
MYRMQLLSCIALSLALVTNS

SEQ ID NO: 213272 - protein, 6 aa, Artificial Sequence
  Description of Artificial Sequence: Synthetic Linker
EFSTEF

SEQ ID NO: 213273 - protein, 133 aa, Homo sapiens [sequence omitted]

SEQ ID NO: 213274 - protein, 107 aa, Artificial Sequence
  Description of Artificial Sequence: Synthetic Destabilized Domain (DD)
GVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 213275 - protein, 158 aa, Artificial Sequence
  Description of Artificial Sequence: Synthetic Destabilized Domain (DD)
ISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERR

SEQ ID NO: 213276 - protein, 268 aa, Artificial Sequence
  Description of Artificial Sequence: Synthetic polypeptide
MYRMQLLSCIALSLALVTNSEFSTEFGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEMHAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 213277 - protein, 153 aa, Artificial Sequence; identical to SEQ ID NO: 41474
  Description of Artificial Sequence: Synthetic polypeptide

SEQ ID NO: 213278 - protein, 319 aa, Artificial Sequence
  Description of Artificial Sequence: Synthetic polypeptide
MYRMQLLSCIALSLALVTNSEFSTEFISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERRMHAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 213279 - DNA, 60 bp, Artificial Sequence
  Description of Artificial Sequence: Synthetic Signal Sequence
atgtaccgaatgcaactgctgagctgcatcgccctgagcctggcactcgtgaccaacagc

SEQ ID NO: 213280 - DNA, 60 bp, Homo sapiens; identical to SEQ ID NO: 213279

SEQ ID NO: 213281 - DNA, 18 bp, Artificial Sequence
  Description of Artificial Sequence: Synthetic Linker
gagttcagcaccgagttt

SEQ ID NO: 213282 - DNA, 402 bp, Artificial Sequence
  Description of Artificial Sequence: Synthetic polynucleotide
gcgccaactagtagcagcacaaaaaagacacagcttcaactggagcacctgctgctggacctgcagatgatccttaacggaatcaacaactacaagaaccccaagctgaccaggatgctgacgtttaagttttacatgcccaagaaggccaccgaactcaaacacctgcaatgcctggaggaagagctgaaaccgcttgaggaagtgttgaacctggcccaaagcaagaatttccacctgaggcccagggacctgataagcaacatcaacgtgatcgtgctggaactgaagggtagcgagaccaccttcatgtgcgagtacgccgacgagaccgcaaccatcgtggagttcctgaaccgatggataacattctgccagagcatcattagcactctgacctga

SEQ ID NO: 213283 - DNA, 402 bp, Homo sapiens
gcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttga

SEQ ID NO: 213284 - DNA, 321 bp, Artificial Sequence
  Description of Artificial Sequence: Synthetic Destabilized Domain (DD)
ggcgtgcaggttgagactataagcccaggcgacggcaggaccttccccaagaggggccagacatgcgtggtgcactacaccggcatgcttgaagacggcaaaaaggtggactcaagcagggacaggaacaagcccttcaagttcatgttgggcaaacaggaggtgatcagaggctgggaggagggtgttgcccagatgagcgtggggcagagggccaagctcacgataagtcccgattacgcctacggcgccaccggtcaccccggcatcatccccccacacgccaccctggtgttcgacgtggaattgctgaagcccgag

SEQ ID NO: 213285 - DNA, 474 bp, Artificial Sequence
  Description of Artificial Sequence: Synthetic Destabilized Domain (DD)
atctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgt

SEQ ID NO: 213286 - DNA, 807 bp, Artificial Sequence
  Description of Artificial Sequence: Synthetic polynucleotide
atgtaccgaatgcaactgctgagctgcatcgccctgagcctggcactcgtgaccaacagcgagttcagcaccgagtttggcgtgcaggttgagactataagcccaggcgacggcaggaccttccccaagaggggccagacatgcgtggtgcactacaccggcatgcttgaagacggcaaaaaggtggactcaagcagggacaggaacaagcccttcaagttcatgttgggcaaacaggaggtgatcagaggctgggaggagggtgttgcccagatgagcgtggggcagagggccaagctcacgataagtcccgattacgcctacggcgccaccggtcaccccggcatcatccccccacacgccaccctggtgttcgacgtggaattgctgaagcccgagatgcacgcgccaactagtagcagcacaaaaaagacacagcttcaactggagcacctgctgctggacctgcagatgatccttaacggaatcaacaactacaagaaccccaagctgaccaggatgctgacgtttaagttttacatgcccaagaaggccaccgaactcaaacacctgcaatgcctggaggaagagctgaaaccgcttgaggaagtgttgaacctggcccaaagcaagaatttccacctgaggcccagggacctgataagcaacatcaacgtgatcgtgctggaactgaagggtagcgagaccaccttcatgtgcgagtacgccgacgagaccgcaaccatcgtggagttcctgaaccgatggataacattctgccagagcatcattagcactctgacctga

SEQ ID NO: 213287 - DNA, 462 bp, Artificial Sequence
  Description of Artificial Sequence: Synthetic polynucleotide
atgtaccgaatgcaactgctgagctgcatcgccctgagcctggcactcgtgaccaacagcgcgccaactagtagcagcacaaaaaagacacagcttcaactggagcacctgctgctggacctgcagatgatccttaacggaatcaacaactacaagaaccccaagctgaccaggatgctgacgtttaagttttacatgcccaagaaggccaccgaactcaaacacctgcaatgcctggaggaagagctgaaaccgcttgaggaagtgttgaacctggcccaaagcaagaatttccacctgaggcccagggacctgataagcaacatcaacgtgatcgtgctggaactgaagggtagcgagaccaccttcatgtgcgagtacgccgacgagaccgcaaccatcgtggagttcctgaaccgatggataacattctgccagagcatcattagcactctgacctga

SEQ ID NO: 213288 - DNA, 960 bp, Artificial Sequence
  Description of Artificial Sequence: Synthetic polynucleotide
atgtaccgaatgcaactgctgagctgcatcgccctgagcctggcactcgtgaccaacagcgagttcagcaccgagtttatctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgtatgcacgcgccaactagtagcagcacaaaaaagacacagcttcaactggagcacctgctgctggacctgcagatgatccttaacggaatcaacaactacaagaaccccaagctgaccaggatgctgacgtttaagttttacatgcccaagaaggccaccgaactcaaacacctgcaatgcctggaggaagagctgaaaccgcttgaggaagtgttgaacctggcccaaagcaagaatttccacctgaggcccagggacctgataagcaacatcaacgtgatcgtgctggaactgaagggtagcgagaccaccttcatgtgcgagtacgccgacgagaccgcaaccatcgtggagttcctgaaccgatggataacattctgccagagcatcattagcactctgacctga

SEQ ID NO: 213289 - protein, 22 aa, Homo sapiens
MCHQQLVISWFSLVFLASPLVA

SEQ ID NO: 213290 - protein, 5 aa, Artificial Sequence
  Description of Artificial Sequence: Synthetic Linker
GGSGG

SEQ ID NO: 213291 - protein, 15 aa, Artificial Sequence
  Description of Artificial Sequence: Synthetic Linker
GGGGSGGGGSGGGGS

SEQ ID NO: 213292 - protein, 9 aa, Homo sapiens
SARNRQKRS

SEQ ID NO: 213293 - protein, 8 aa, Homo sapiens
ARNRQKRS

SEQ ID NO: 213294 - protein, 12 aa, Homo sapiens
ESRRVRRNKRSK

SEQ ID NO: 213295 - protein, 306 aa, Homo sapiens
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 213296 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 213297 - protein, 107 aa, Artificial Sequence
  Description of Artificial Sequence: Synthetic Destabilized Domain (DD)
GVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 213298 - skipped

SEQ ID NO: 213299 - protein, 652 aa, Artificial Sequence
  Description of Artificial Sequence: Synthetic polypeptide
MCHQQLVISWFSLVFLASPLVAGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEGGSGGIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 213300 - protein, 653 aa, Artificial Sequence
  Description of Artificial Sequence: Synthetic polypeptide
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEGGSGGMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 213301 - protein, 656 aa, Artificial Sequence
  Description of Artificial Sequence: Synthetic polypeptide
MCHQQLVISWFSLVFLASPLVAGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPESARNRQKRSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 213302 - protein, 655 aa, Artificial Sequence
  Description of Artificial Sequence: Synthetic polypeptide
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASARNRQKRSGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 213303 - protein, 651 aa, Artificial Sequence
  Description of Artificial Sequence: Synthetic polypeptide
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGSGGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 213304 - protein, 540 aa, Artificial Sequence
  Description of Artificial Sequence: Synthetic polypeptide
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 213305 - protein, 710 aa, Artificial Sequence
  Description of Artificial Sequence: Synthetic polypeptide
MCHQQLVISWFSLVFLASPLVAISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERRESRRVRRNKRSKIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 213306 - protein, 659 aa, Artificial Sequence
  Description of Artificial Sequence: Synthetic polypeptide
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASESRRVRRNKRSKGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 213307 - DNA, 66 bp, Homo sapiens
atgtgtcaccagcagttggtcatctcttggttttccctggtttttctggcatctcccctcgtggcc

SEQ ID NO: 213308 - DNA, 66 bp, Artificial Sequence
  Description of Artificial Sequence: Synthetic oligonucleotide
atgtgccaccagcagctggtcatcagctggttctccctggtgtttctggcatcccctctggtggca

SEQ ID NO: 213309 - DNA, 66 bp, Artificial Sequence
  Description of Artificial Sequence: Synthetic oligonucleotide
atgtgccaccagcagctggtcatcagctggttctccctggtgtttctggccagccctctggtggcc

SEQ ID NO: 213310 - DNA, 66 bp, Artificial Sequence
  Description of Artificial Sequence: Synthetic oligonucleotide
atgtgccaccagcagctggtcatcagctggttctccctggtgtttctggcaagccctctggtggca

SEQ ID NO: 213311 - DNA, 66 bp, Artificial Sequence
  Description of Artificial Sequence: Synthetic oligonucleotide
atgtgccaccagcagctggtcatcagctggttctccctggtgtttctggcatccccactggtggca

SEQ ID NO: 213312 - DNA, 66 bp, Artificial Sequence
  Description of Artificial Sequence: Synthetic oligonucleotide
atgtgccaccaacagctcgtgatcagctggttctccctggtgttcctggctagccccctggtggcc

SEQ ID NO: 213313 - DNA, 66 bp, Artificial Sequence
  Description of Artificial Sequence: Synthetic oligonucleotide
atgtgccaccagcagctggtcatctcttggttcagcctggtgtttctggcctcccccctggtggcc

SEQ ID NO: 213314 - DNA, 66 bp, Artificial Sequence
  Description of Artificial Sequence: Synthetic oligonucleotide
atgtgccaccagcagctggtcatctcctggttctctctggtgtttctggcatctcctctggtggca

SEQ ID NO: 213315 - DNA, 66 bp, Artificial Sequence
  Description of Artificial Sequence: Synthetic oligonucleotide
atgtgccaccagcagctggtcatctcttggttcagcctggtgtttctggcatccccactggtggca

SEQ ID NO: 213316 - DNA, 15 bp, Artificial Sequence
  Description of Artificial Sequence: Synthetic Linker
ggaggatccggaggc

SEQ ID NO: 213317 - DNA, 15 bp, Artificial Sequence
  Description of Artificial Sequence: Synthetic Linker
ggaggatctggagga

SEQ ID NO: 213318 - DNA, 45 bp, Artificial Sequence
  Description of Artificial Sequence: Synthetic Linker
ggaggaggaggatccggaggaggaggatctggcggaggaggcagc

SEQ ID NO: 213319 - DNA, 45 bp, Artificial Sequence
  Description of Artificial Sequence: Synthetic Linker
ggaggaggaggaagcggaggaggaggatccggcggaggaggctct

SEQ ID NO: 213320 - DNA, 45 bp, Artificial Sequence
  Description of Artificial Sequence: Synthetic Linker
ggaggaggaggcagcggaggaggaggttctggaggaggcggcagc

SEQ ID NO: 213321 - DNA, 45 bp, Artificial Sequence
  Description of Artificial Sequence: Synthetic Linker
ggcggcggcggctctggaggaggaggcagcggcggaggaggctcc

SEQ ID NO: 213322 - DNA, 45 bp, Artificial Sequence
  Description of Artificial Sequence: Synthetic Linker
ggaggaggaggcagcggcggaggaggctccggcggcggcggctct

SEQ ID NO: 213323 - DNA, 12 bp, Artificial Sequence
  Description of Artificial Sequence: Synthetic Linker
ggaggatctgga

SEQ ID NO: 213324 - DNA, 27 bp, Homo sapiens
agcgccaggaatcgccagaagcggtcc

SEQ ID NO: 213325 - DNA, 24 bp, Homo sapiens
gcccggaatagacagaagagatct

SEQ ID NO: 213326 - DNA, 36 bp, Artificial Sequence
  Description of Artificial Sequence: Synthetic Cleavage site
gagtctaggcgcgtgcggagaaataagcggagcaag

SEQ ID NO: 213327 - DNA, 36 bp, Artificial Sequence
  Description of Artificial Sequence: Synthetic Cleavage site
gagtctcggagagtgaggcgcaataagaggagcaag

SEQ ID NO: 213328 - DNA, 36 bp, Artificial Sequence
  Description of Artificial Sequence: Synthetic Cleavage site
gagtccaggagagtgcggcgcaacaagaggagcaag

SEQ ID NO: 213329 - DNA, 921 bp, Artificial Sequence
  Description of Artificial Sequence: Synthetic Cleavage site
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagttag

SEQ ID NO: 213330 - DNA, 918 bp, Artificial Sequence
  Description of Artificial Sequence: Synthetic polynucleotide
atctgggagctgaagaaggacgtgtacgtggtggagctggactggtatcccgatgcccctggcgagatggtggtgctgacctgcgacacacctgaggaggatggcatcacctggacactggatcagtctagcgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtcctctaggggcagctccgacccccagggcgtgacatgcggagcagccaccctgtccgccgagagggtgcgcggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatccgggacatcatcaagcccgatccacccaagaacctgcagctgaagcctctgaagaattctagacaggtggaggtgagctgggagtacccagacacctggtccacaccccactcttatttcagcctgaccttttgcgtgcaggtgcagggcaagagcaagagggagaagaaggaccgcgtgttcaccgataagacatccgccaccgtgatctgtaggaagaacgcctccatctctgtgagggcccaggatcgctactattcctctagctggtccgagtgggcctctgtgccctgtagc

SEQ ID NO: 213331 - DNA, 918 bp, Artificial Sequence
  Description of Artificial Sequence: Synthetic polynucleotide
atctgggagctgaagaaggacgtgtacgtggtggagctggactggtatcccgatgcccctggcgagatggtggtgctgacctgcgacacaccagaggaggatggcatcacctggacactggatcagtctagcgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtcctctaggggcagctccgacccccagggcgtgacatgcggagcagccaccctgtccgccgagagggtgcgcggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatccgggacatcatcaagcccgatccacccaagaacctgcagctgaagcctctgaagaattctagacaggtggaggtgagctgggagtacccagacacctggtccacaccccactcttatttcagcctgaccttttgcgtgcaggtgcagggcaagtccaagagggagaagaaggaccgcgtgttcaccgataagacatctgccaccgtgatctgtaggaagaacgcctccatctctgtgagggcccaggatcgctactattcctctagctggtccgagtgggcctctgtgccctgtagc

SEQ ID NO: 213332 - DNA, 918 bp, Artificial Sequence
  Description of Artificial Sequence: Synthetic polynucleotide
atctgggagctgaagaaggacgtgtacgtggtggagctggactggtatcccgatgcccctggcgagatggtggtgctgacctgcgacacacctgaggaggatggcatcacctggacactggatcagtctagcgaggtgctgggctccggcaagaccctgacaatccaggtgaaggagttcggcgacgccggccagtacacatgtcacaagggcggcgaggtgctgtctcacagcctgctgctgctgcacaagaaggaggacggcatctggtccacagacatcctgaaggatcagaaggagccaaagaacaagaccttcctgaggtgcgaggccaagaattatagcggccgctttacctgttggtggctgaccacaatcagcaccgatctgacattttccgtgaagtcctctaggggcagctccgacccccagggcgtgacatgcggagcagccaccctgtccgccgagcgggtgagaggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatcagggacatcatcaagcccgatccacccaagaacctgcagctgaagcctctgaagaattctcgccaggtggaggtgagctgggagtacccagacacctggagcacaccccactcttatttcagcctgaccttttgcgtgcaggtgcagggcaagtctaagcgggagaagaaggacagagtgttcaccgataagacaagcgccaccgtgatctgtcggaagaacgcctccatctctgtgcgggcccaggatagatactattcctctagctggtccgagtgggcctctgtgccctgtagc

SEQ ID NO: 213333 - DNA, 918 bp, Artificial Sequence
  Description of Artificial Sequence: Synthetic polynucleotide
atctgggagctgaagaaggacgtgtacgtggtggagctggactggtatcccgatgcccctggcgagatggtggtgctgacctgcgacacacctgaggaggatggcatcacctggacactggatcagagctccgaggtgctgggaagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgaggtgcgaggccaagaattatagcggccgctttacctgttggtggctgaccacaatcagcaccgatctgacattttccgtgaagtctagcagaggctcctctgacccccagggcgtgacatgcggagcagccaccctgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctcgccaggtggaggtgagctgggagtacccagacacctggtccacaccccactcttatttcagcctgaccttttgcgtgcaggtgcagggcaagagcaagagggagaagaaggaccgcgtgttcaccgataagacatccgccaccgtgatctgtcggaagaacgcctccatctctgtgcgggcccaggatagatactattctagctcctggtccgagtgggcctctgtgccctgtagc

SEQ ID NO: 213334 - DNA, 918 bp, Artificial Sequence
  Description of Artificial Sequence: Synthetic polynucleotide
atctgggagctgaagaaggacgtgtacgtggtggagctggactggtatcccgatgcccctggcgagatggtggtgctgacctgcgacacacctgaggaggatggcatcacctggacactggatcagagctccgaggtgctgggaagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtctagccggggctcctctgacccacagggagtgacatgcggagcagccaccctgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctcgccaggtggaggtgagctgggagtacccagacacctggtccacaccccactcttatttcagcctgaccttttgcgtgcaggtgcagggcaagtccaagcgggagaagaaggacagagtgttcaccgataagacatctgccaccgtgatctgtcggaagaacgcctccatctctgtgagggcccaggatcgctactattctagctcctggagcgagtgggcatccgtgccatgttct

SEQ ID NO: 213335 - DNA, 918 bp, Artificial Sequence
  Description of Artificial Sequence: Synthetic polynucleotide
atctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagc

SEQ ID NO: 213336 - DNA, 918 bp, Artificial Sequence
  Description of Artificial Sequence: Synthetic polynucleotide
atctgggagctgaagaaggacgtgtacgtggtggagctggactggtatcccgatgcccctggcgagatggtggtgctgacctgcgacacacccgaggaggatggcatcacctggacactggatcagtctagcgaggtgctgggctccggcaagaccctgacaatccaggtgaaggagttcggcgacgccggccagtacacctgtcacaagggcggcgaggtgctgtcccactctctgctgctgctgcacaagaaggaggacggcatctggtctacagacatcctgaaggatcagaaggagcctaagaacaagaccttcctgcggtgcgaggccaagaattatagcggccggttcacctgttggtggctgaccacaatcagcaccgatctgacattttccgtgaagtcctctcggggcagctccgacccacagggagtgacatgcggagcagccaccctgtccgccgagagggtgcgcggcgataacaaggagtacgagtattccgtggagtgccaggaggactctgcctgtccagcagcagaggagagcctgccaatcgaagtgatggtggatgccgtgcacaagctgaagtacgagaattatacatctagcttctttatccgggacatcatcaagcccgatccccctaagaacctgcagctgaagcctctgaagaattctagacaggtggaggtgagctgggagtaccccgacacctggagcacacctcacagctatttctccctgaccttttgcgtgcaggtgcagggcaagtccaagagggagaagaaggaccgcgtgttcaccgataagacatctgccaccgtgatctgtcggaagaacgccagcatctccgtgagggcccaggatcgctactattcctctagctggtctgagtgggccagcgtgccctgttcc

SEQ ID NO: 213337 - DNA, 918 bp, Artificial Sequence
  Description of Artificial Sequence: Synthetic polynucleotide
atctgggagctgaagaaggacgtgtacgtggtggagctggactggtatcctgatgccccaggcgagatggtggtgctgacatgcgacacccccgaggaggatggcatcacatggaccctggatcagtcctctgaggtgctgggctccggcaagacactgaccatccaggtgaaggagttcggcgacgccggccagtacacctgtcacaagggaggagaggtgctgagccactccctgctgctgctgcacaagaaggaggacggcatctggtccaccgacatcctgaaggatcagaaggagcccaagaacaagacattcctgagatgcgaggccaagaattatagcggcaggtttacctgttggtggctgacaaccatctccacagatctgaccttttctgtgaagagctcccggggctctagcgaccctcagggagtgacctgcggagcagccacactgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacctcctctttctttatcagagacatcatcaagccagatcctccaaagaacctgcagctgaagcccctgaagaatagcaggcaggtggaggtgtcctgggagtacccagacacatggagcaccccccacagctatttctccctgacattttgcgtgcaggtgcagggcaagtccaagcgcgagaagaaggaccgggtgttcacagataagacctctgccacagtgatctgtcgcaagaacgcctctatcagcgtgcgcgcccaggatcggtactatagctcctcttggtctgagtgggccagcgtgccttgttcc

SEQ ID NO: 213338 - DNA, 918 bp, Artificial Sequence
  Description of Artificial Sequence: Synthetic polynucleotide
atctgggagctgaagaaggacgtgtacgtggtggagctggactggtatcccgatgcccctggcgagatggtggtgctgacctgcgacacacctgaggaggatggcatcacctggacactggatcagagctccgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatctggtccacagacatcctgaaggatcagaaggagccaaagaacaagaccttcctgaggtgcgaggccaagaattattctggcaggttcacctgttggtggctgaccacaatcagcaccgatctgacattttccgtgaagtctagccggggctcctctgacccccagggagtgacatgcggagcagccaccctgtccgccgagagggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctagacaggtggaggtgagctgggagtacccagacacctggagcacaccccactcctatttctctctgaccttttgcgtgcaggtgcagggcaagagcaagagggagaagaaggacagagtgttcaccgataagacatccgccaccgtgatctgtcggaagaacgcctccatctctgtgcgggcccaggatcgctactattctagctcctggagcgagtgggcatccgtgccatgttct

SEQ ID NO: 213339 - DNA, 582 bp, Homo sapiens
gtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaa

SEQ ID NO: 213340 - DNA, 594 bp, Artificial Sequence
  Description of Artificial Sequence: Synthetic polynucleotide
cgcaatctgccagtggccacccctgacccaggcatgttcccctgcctgcaccacagccagaacctgctgagggccgtgtccaatatgctgcagaaggcccgccagacactggagttttacccttgtacctctgaggagatcgaccacgaggatatcacaaaggataagaccagcacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctcttga

SEQ ID NO: 213341 - DNA, 594 bp, Artificial Sequence
  Description of Artificial Sequence: Synthetic polynucleotide
cgcaatctgccagtggccacccctgacccaggcatgttcccctgcctgcaccacagccagaacctgctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctcttga

SEQ ID NO: 213342 - DNA, 594 bp, Artificial Sequence
  Description of Artificial Sequence: Synthetic polynucleotide
agaaatctgccagtggccacccctgacccaggcatgttcccctgcctgcaccactctcagaacctgctgcgggccgtgagcaatatgctgcagaaggccagacagacactggagttttacccttgtacctccgaggagatcgaccacgaggatatcacaaaggataagacctctacagtggaggcctgcctgccactggagctgaccaagaacgagtcctgtctgaacagccgggaaaccagcttcatcaccaacggctcctgcctggcctctagaaagaccagcttcatgatggccctgtgcctgtcctctatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttaggatccgcgccgtgaccatcgaccgcgtgatgtcctatctgaatgcctcttga

SEQ ID NO: 213343 - DNA, 591 bp, Artificial Sequence
  Description of Artificial Sequence: Synthetic polynucleotide
agaaatctgccagtggcaacccctgacccaggaatgttcccttgcctgcaccacagccagaacctgctgcgggccgtgtccaatatgctgcagaaggccagacagacactggagttttacccttgtacctctgaggagatcgaccacgaggatatcacaaaggataagaccagcacagtggaggcctgcctgccactggagctgaccaagaacgagtcctgtctgaacagccgggaaaccagcttcatcaccaacggctcctgcctggcctctcgcaagaccagcttcatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagtcctctctggaggagcccgatttctacaagaccaagatcaagctgtgcatcctgctgcacgcctttaggatccgcgccgtgaccatcgacagagtgatgtcctatctgaacgcctct

SEQ ID NO: 213344 - DNA, 591 bp, Artificial Sequence
  Description of Artificial Sequence: Synthetic polynucleotide
agaaatctgccagtggcaacccctgacccaggaatgttcccttgcctgcaccacagccagaacctgctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagagctgtctgaattcccgggagacatctttcatcaccaacggcagctgcctggcctccagaaagacatcttttatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagtcctctctggaggagcccgatttctacaagaccaagatcaagctgtgcatcctgctgcacgcctttaggatccgcgccgtgaccatcgaccgcgtgatgtcttatctgaacgcatcc

SEQ ID NO: 213345 - DNA, 594 bp, Artificial Sequence
  Description of Artificial Sequence: Synthetic polynucleotide
agaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagctaa

SEQ ID NO: 213346 - DNA, 597 bp, Artificial Sequence
  Description of Artificial Sequence: Synthetic polynucleotide
agaaatctgccagtggccacccctgacccaggcatgttcccctgcctgcaccacagccagaacctgctgagggccgtgtccaatatgctgcagaaggcccgccagacactggagttttacccctgtaccagcgaggagatcgaccacgaggatatcacaaaggataagacctccacagtggaggcctgcctgcctctggagctgaccaagaacgagtcttgtctgaatagcagggagacatccttcatcaccaacggctcttgcctggccagccgcaagacatcctttatgatggccctgtgcctgtcctctatctacgaggacctgaagatgtatcaggtggagttcaagaccatgaacgccaagctgctgatggaccctaagaggcagatctttctggatcagaatatgctggccgtgatcgacgagctgatgcaggccctgaacttcaattccgagacagtgcctcagaagagctccctggaggagccagatttctacaagaccaagatcaagctgtgcatcctgctgcacgcctttcggatcagagccgtgaccatcgaccgcgtgatgtcttatctgaatgccagcggatcc

SEQ ID NO: 213347 - DNA, 597 bp, Artificial Sequence
  Description of Artificial Sequence: Synthetic polynucleotide
cggaatctgcctgtggcaacccccgaccctggaatgttcccatgcctgcaccacagccagaacctgctgcgcgccgtgtccaatatgctgcagaaggcccggcagaccctggagttttacccatgtacaagcgaggagatcgaccacgaggatatcaccaaggataagacatccaccgtggaggcatgcctgccactggagctgacaaagaacgagtcttgtctgaacagccgggagacaagcttcatcacaaacggctcttgcctggccagccggaagacctcctttatgatggccctgtgcctgagctccatctacgaggacctgaagatgtatcaggtggagttcaagacaatgaacgccaagctgctgatggaccccaagcgccagatctttctggatcagaatatgctggccgtgatcgacgagctgatgcaggccctgaactttaatagcgagacagtgccccagaagtctagcctggaggagcctgatttctacaagacaaagatcaagctgtgcatcctgctgcacgccttccggatcagagccgtgaccatcgacagagtgatgtcttatctgaatgccagcggatcc

SEQ ID NO: 213348 - DNA, 591 bp, Artificial Sequence
  Description of Artificial Sequence: Synthetic polynucleotide
cgcaatctgccagtggcaacccctgacccaggaatgttcccttgcctgcaccacagccagaacctgctgcgggccgtgtccaatatgctgcagaaggcccgccagacactggagttttacccttgtacctctgaggagatcgaccacgaggatatcacaaaggataagaccagcacagtggaggcctgcctgccactggagctgaccaagaacgagagctgtctgaattccagggagacatctttcatcaccaacggcagctgcctggcctccagaaagacatcttttatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaattccgagacagtgccacagaagtcctctctggaggagcccgatttctacaagaccaagatcaagctgtgcatcctgctgcacgccttcaggatcagggccgtgaccatcgacagagtgatgagctatctgaacgccagc

SEQ ID NO: 213349 - DNA, 321 bp, Artificial Sequence
  Description of Artificial Sequence: Synthetic Destabilized Domain (DD)
ggagtgcaggtggagacaatctctcctggcgatggccggaccttcccaaagagaggccagacatgcgtggtgcactacaccggcatgctggaggacggcaagaaggtggacagctcccgggatagaaacaagccattcaagtttatgctgggcaagcaggaagtgatcaggggatgggaggagggagtggcacagatgtctgtgggccagagagccaagctgacaatcagccctgattacgcatatggagcaaccggacacccaggaatcatcccacctcacgccaccctggtgtttgatgtggagctgctgaagccagag

SEQ ID NO: 213350 - DNA, 324 bp, Artificial Sequence
  Description of Artificial Sequence: Synthetic Destabilized Domain (DD)
atgggcgtgcaggtggagacaatctcccctggcgatggccggaccttcccaaagagaggccagacatgcgtggtgcactacaccggcatgctggaggacggcaagaaggtggacagctcccgggatagaaacaagcctttcaagtttatgctgggcaagcaggaagtgatcaggggatgggaggagggagtggcacagatgtctgtgggccagagagccaagctgacaatcagccctgattacgcatatggagcaaccggacacccaggaatcatcccacctcacgccaccctggtgtttgacgtggagctgctgaagccagag

SEQ ID NO: 213351 - DNA, 320 bp, Artificial Sequence
  Description of Artificial Sequence: Synthetic Destabilized Domain (DD)
gagtgcaggtggagacaatctcccctggcgatggcaggaccttcccaaagcgcggccagacatgcgtggtgcactacaccggcatgctggaggacggcaagaaggtggacagctcccgggatagaaacaagccattcaagtttatgctgggcaagcaggaagtgatcaggggatgggaggagggagtggcacagatgtccgtgggacagcgcgccaagctgacaatctctcctgattacgcatatggagcaaccggacacccaggaatcatcccacctcacgccaccctggtgtttgacgtggagctgctgaagcccgag

SEQ ID NO: 213352 - DNA, 324 bp, Artificial Sequence
  Description of Artificial Sequence: Synthetic Destabilized Domain (DD)
ggcgtgcaggtggagacaatcagccccggcgatggccggacctttcctaagagaggccagacatgcgtggtgcactacaccggcatgctgggcgacggcaagaaggtggacagctccagggatcgcaataagcccttcaagtttatgctgggcaagcaggaagtgatcaggggatgggaggagggagtggcacagatgtccgtgggacagggcgccaagctgacaatctctccagattacgcatatggagcaaccggacacccaggaatcatcccaccccacgccaccctggtgttcgacgtggagctgctggagctggagtga

SEQ ID NO: 213353 - DNA, 324 bp, Artificial Sequence
  Description of Artificial Sequence: Synthetic Destabilized Domain (DD)
ggagtgcaggtggagacaatcagccccggcgatggcaggacctttcctaagcgcggccagacatgcgtggtgcactacaccggcatgctgggcgacggcaagaaggtggacagctcccgggatagaaataagcccttcaagtttatgctgggcaagcaggaagtgatcagaggctgggaggagggagtggcacagatgtctgtgggacagggcgccaagctgacaatcagcccagattacgcatatggagcaaccggacacccaggaatcatcccaccccacgccaccctggtgttcgacgtggagctgctggagctggagtga

SEQ ID NO: 213354 - DNA, 330 bp, Artificial Sequence
  Description of Artificial Sequence: Synthetic Destabilized Domain (DD)
ggcgtgcaggtggagacaatcagccccggcgatggccggacctttcctaagcgcggccagacatgcgtggtgcactacaccggcatgctgggcgacggcaagaaggtggacagctccagggatagaaacaagccattcaagtttatgctgggcaagcaggaagtgatcagaggatgggaggagggagtggcacagatgtccgtgggacagggcgccaagctgacaatctctccagattacgcatatggagcaaccggacacccaggaatcatcccaccccacgccaccctggtgttcgacgtggagctgctggagctggagtgaggatcc

SEQ ID NO: 213355 - DNA, 474 bp, Artificial Sequence
  Description of Artificial Sequence: Synthetic Destabilized Domain (DD)
atctctctgatcgccgccctggccgtggattacgtgatcggcatggagaacgccatgccatggaatctgccagcagacctggcatggttcaagaggaacacactgaataagccagtgatcatgggcagacacacctgggagtccatcggccggccactgccaggcagaaagaacatcatcctgagctcccagcccggcacagacgatagggtgacctgggtgaagagcgtggacgaggcaatcgcagcatgcggcgatgtgcctgagatcatggtcatcggaggaggacgcgtgatcgagcagttcctgccaaaggcccagaagctgtacctgacacacatcgatgccgaggtggagggcgacacccactttcctgattatgagccagacgattgggagtccgtgttctctgagtttcacgacgccgatgcccagaactctcacagctattgttttgagatcctggagcggaga

SEQ ID NO: 213356 - DNA, 1959 bp, Artificial Sequence
  Description of Artificial Sequence: Synthetic polynucleotide
atgtgccaccagcagctggtcatcagctggttctccctggtgtttctggcatcccctctggtggcaggagtgcaggtggagacaatctctcctggcgatggccggaccttcccaaagagaggccagacatgcgtggtgcactacaccggcatgctggaggacggcaagaaggtggacagctcccgggatagaaacaagccattcaagtttatgctgggcaagcaggaagtgatcaggggatgggaggagggagtggcacagatgtctgtgggccagagagccaagctgacaatcagccctgattacgcatatggagcaaccggacacccaggaatcatcccacctcacgccaccctggtgtttgatgtggagctgctgaagccagagggaggatccggaggcatctgggagctgaagaaggacgtgtacgtggtggagctggactggtatcccgatgcccctggcgagatggtggtgctgacctgcgacacacctgaggaggatggcatcacctggacactggatcagtctagcgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtcctctaggggcagctccgacccccagggcgtgacatgcggagcagccaccctgtccgccgagagggtgcgcggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatccgggacatcatcaagcccgatccacccaagaacctgcagctgaagcctctgaagaattctagacaggtggaggtgagctgggagtacccagacacctggtccacaccccactcttatttcagcctgaccttttgcgtgcaggtgcagggcaagagcaagagggagaagaaggaccgcgtgttcaccgataagacatccgccaccgtgatctgtaggaagaacgcctccatctctgtgagggcccaggatcgctactattcctctagctggtccgagtgggcctctgtgccctgtagcggaggaggaggatccggaggaggaggatctggcggcggcggcagccgcaatctgccagtggccacccctgacccaggcatgttcccctgcctgcaccacagccagaacctgctgagggccgtgtccaatatgctgcagaaggcccgccagacactggagttttacccttgtacctctgaggagatcgaccacgaggatatcacaaaggataagaccagcacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctcttga

SEQ ID NO: 213357 - DNA, 1961 bp, Artificial Sequence
  Description of Artificial Sequence: Synthetic polynucleotide
atgggcgtgcaggtggagacaatctcccctggcgatggccggaccttcccaaagagaggccagacatgcgtggtgcactacaccggcatgctggaggacggcaagaaggtggacagctcccgggatagaaacaagcctttcaagtttatgctgggcaagcaggaagtgatcaggggatgggaggagggagtggcacagatgtctgtgggccagagagccaagctgacaatcagccctgattacgcatatggagcaaccggacacccaggaatcatcccacctcacgccaccctggtgtttgacgtggagctgctgaagccagagggaggatctggaggaatgtgccaccagcagctggtcatcagctggttctccctggtgtttctggccagccctctggtggccatctgggagctgaagaaggacgtgtacgtggtggagctggactggtatcccgatgcccctggcgagatggtggtgctgacctgcgacacaccagaggaggatggcatcacctggacactggatcagtctagcgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtcctctaggggcagctccgacccccagggcgtgacatgcggagcagccaccctgtccgccgagagggtgcgcggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatccgggacatcatcaagcccgatccacccaagaacctgcagctgaagcctctgaagaattctagacaggtggaggtgagctgggagtacccagacacctggtccacaccccactcttatttcagcctgaccttttgcgtgcaggtgcagggcaagtccaagagggagaagaaggaccgcgtgttcaccgataagacatctgccaccgtgatctgtaggaagaacgcctccatctctgtgagggcccaggatcgctactattcctctagctggtccgagtgggcctctgtgccctgtagcggaggaggaggatccggaggaggaggatctggcggcggcggcagccgcaatctgccagtggccacccctgacccaggcatgttcccctgcctgcaccacagccagaacctgctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctcttg

SEQ ID NO: 213358 - DNA, 1971 bp, Artificial Sequence
  Description of Artificial Sequence: Synthetic polynucleotide
atgtgccaccagcagctggtcatcagctggttctccctggtgtttctggcaagccctctggtggcaggagtgcaggtggagacaatctcccctggcgatggcaggaccttcccaaagcgcggccagacatgcgtggtgcactacaccggcatgctggaggacggcaagaaggtggacagctcccgggatagaaacaagccattcaagtttatgctgggcaagcaggaagtgatcaggggatgggaggagggagtggcacagatgtccgtgggacagcgcgccaagctgacaatctctcctgattacgcatatggagcaaccggacacccaggaatcatcccacctcacgccaccctggtgtttgacgtggagctgctgaagcccgagagcgccaggaatcgccagaagcggtccatctgggagctgaagaaggacgtgtacgtggtggagctggactggtatcccgatgcccctggcgagatggtggtgctgacctgcgacacacctgaggaggatggcatcacctggacactggatcagtctagcgaggtgctgggctccggcaagaccctgacaatccaggtgaaggagttcggcgacgccggccagtacacatgtcacaagggcggcgaggtgctgtctcacagcctgctgctgctgcacaagaaggaggacggcatctggtccacagacatcctgaaggatcagaaggagccaaagaacaagaccttcctgaggtgcgaggccaagaattatagcggccgctttacctgttggtggctgaccacaatcagcaccgatctgacattttccgtgaagtcctctaggggcagctccgacccccagggcgtgacatgcggagcagccaccctgtccgccgagcgggtgagaggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatcagggacatcatcaagcccgatccacccaagaacctgcagctgaagcctctgaagaattctcgccaggtggaggtgagctgggagtacccagacacctggagcacaccccactcttatttcagcctgaccttttgcgtgcaggtgcagggcaagtctaagcgggagaagaaggacagagtgttcaccgataagacaagcgccaccgtgatctgtcggaagaacgcctccatctctgtgcgggcccaggatagatactattcctctagctggtccgagtgggcctctgtgccctgtagcggaggaggaggatccggaggaggaggatctggcggcggcggcagcagaaatctgccagtggccacccctgacccaggcatgttcccctgcctgcaccactctcagaacctgctgcgggccgtgagcaatatgctgcagaaggccagacagacactggagttttacccttgtacctccgaggagatcgaccacgaggatatcacaaaggataagacctctacagtggaggcctgcctgccactggagctgaccaagaacgagtcctgtctgaacagccgggaaaccagcttcatcaccaacggctcctgcctggcctctagaaagaccagcttcatgatggccctgtgcctgtcctctatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttaggatccgcgccgtgaccatcgaccgcgtgatgtcctatctgaatgcctcttga

SEQ ID NO: 213359 - DNA, 1968 bp, Artificial Sequence
  Description of Artificial Sequence: Synthetic polynucleotide
atgtgccaccagcagctggtcatcagctggttctccctggtgtttctggcatccccactggtggcaatctgggagctgaagaaggacgtgtacgtggtggagctggactggtatcccgatgcccctggcgagatggtggtgctgacctgcgacacacctgaggaggatggcatcacctggacactggatcagagctccgaggtgctgggaagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgaggtgcgaggccaagaattatagcggccgctttacctgttggtggctgaccacaatcagcaccgatctgacattttccgtgaagtctagcagaggctcctctgacccccagggcgtgacatgcggagcagccaccctgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctcgccaggtggaggtgagctgggagtacccagacacctggtccacaccccactcttatttcagcctgaccttttgcgtgcaggtgcagggcaagagcaagagggagaagaaggaccgcgtgttcaccgataagacatccgccaccgtgatctgtcggaagaacgcctccatctctgtgcgggcccaggatagatactattctagctcctggtccgagtgggcctctgtgccctgtagcggaggaggaggatccggaggaggaggatctggcggaggaggcagcagaaatctgccagtggcaacccctgacccaggaatgttcccttgcctgcaccacagccagaacctgctgcgggccgtgtccaatatgctgcagaaggccagacagacactggagttttacccttgtacctctgaggagatcgaccacgaggatatcacaaaggataagaccagcacagtggaggcctgcctgccactggagctgaccaagaacgagtcctgtctgaacagccgggaaaccagcttcatcaccaacggctcctgcctggcctctcgcaagaccagcttcatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagtcctctctggaggagcccgatttctacaagaccaagatcaagctgtgcatcctgctgcacgcctttaggatccgcgccgtgaccatcgacagagtgatgtcctatctgaacgcctctgcccggaatagacagaagagatctggcgtgcaggtggagacaatcagccccggcgatggccggacctttcctaagagaggccagacatgcgtggtgcactacaccggcatgctgggcgacggcaagaaggtggacagctccagggatcgcaataagcccttcaagtttatgctgggcaagcaggaagtgatcaggggatgggaggagggagtggcacagatgtccgtgggacagggcgccaagctgacaatctctccagattacgcatatggagcaaccggacacccaggaatcatcccaccccacgccaccctggtgttcgacgtggagctgctggagctggagtga

SEQ ID NO: 213360 - DNA, 1956 bp, Artificial Sequence
  Description of Artificial Sequence: Synthetic polynucleotide
atgtgccaccagcagctggtcatcagctggttctccctggtgtttctggcatccccactggtggcaatctgggagctgaagaaggacgtgtacgtggtggagctggactggtatcccgatgcccctggcgagatggtggtgctgacctgcgacacacctgaggaggatggcatcacctggacactggatcagagctccgaggtgctgggaagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtctagccggggctcctctgacccacagggagtgacatgcggagcagccaccctgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctcgccaggtggaggtgagctgggagtacccagacacctggtccacaccccactcttatttcagcctgaccttttgcgtgcaggtgcagggcaagtccaagcgggagaagaaggacagagtgttcaccgataagacatctgccaccgtgatctgtcggaagaacgcctccatctctgtgagggcccaggatcgctactattctagctcctggagcgagtgggcatccgtgccatgttctggaggaggaggaagcggaggaggaggatccggcggaggaggctctagaaatctgccagtggcaacccctgacccaggaatgttcccttgcctgcaccacagccagaacctgctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagagctgtctgaattcccgggagacatctttcatcaccaacggcagctgcctggcctccagaaagacatcttttatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagtcctctctggaggagcccgatttctacaagaccaagatcaagctgtgcatcctgctgcacgcctttaggatccgcgccgtgaccatcgaccgcgtgatgtcttatctgaacgcatccggaggatctggaggagtgcaggtggagacaatcagccccggcgatggcaggacctttcctaagcgcggccagacatgcgtggtgcactacaccggcatgctgggcgacggcaagaaggtggacagctcccgggatagaaataagcccttcaagtttatgctgggcaagcaggaagtgatcagaggctgggaggagggagtggcacagatgtctgtgggacagggcgccaagctgacaatcagcccagattacgcatatggagcaaccggacacccaggaatcatcccaccccacgccaccctggtgttcgacgtggagctgctggagctggagtga

SEQ ID NO: 213361 - DNA, 1623 bp, Artificial Sequence
  Description of Artificial Sequence: Synthetic polynucleotide
atgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagctaa

SEQ ID NO: 213362 - DNA, 2136 bp, Artificial Sequence
  Description of Artificial Sequence: Synthetic polynucleotide
atgtgccaccagcagctggtcatctcttggttcagcctggtgtttctggcctcccccctggtggccatctctctgatcgccgccctggccgtggattacgtgatcggcatggagaacgccatgccatggaatctgccagcagacctggcatggttcaagaggaacacactgaataagccagtgatcatgggcagacacacctgggagtccatcggccggccactgccaggcagaaagaacatcatcctgagctcccagcccggcacagacgatagggtgacctgggtgaagagcgtggacgaggcaatcgcagcatgcggcgatgtgcctgagatcatggtcatcggaggaggacgcgtgatcgagcagttcctgccaaaggcccagaagctgtacctgacacacatcgatgccgaggtggagggcgacacccactttcctgattatgagccagacgattgggagtccgtgttctctgagtttcacgacgccgatgcccagaactctcacagctattgttttgagatcctggagcggagagagtctaggcgcgtgcggagaaataagcggagcaagatctgggagctgaagaaggacgtgtacgtggtggagctggactggtatcccgatgcccctggcgagatggtggtgctgacctgcgacacacccgaggaggatggcatcacctggacactggatcagtctagcgaggtgctgggctccggcaagaccctgacaatccaggtgaaggagttcggcgacgccggccagtacacctgtcacaagggcggcgaggtgctgtcccactctctgctgctgctgcacaagaaggaggacggcatctggtctacagacatcctgaaggatcagaaggagcctaagaacaagaccttcctgcggtgcgaggccaagaattatagcggccggttcacctgttggtggctgaccacaatcagcaccgatctgacattttccgtgaagtcctctcggggcagctccgacccacagggagtgacatgcggagcagccaccctgtccgccgagagggtgcgcggcgataacaaggagtacgagtattccgtggagtgccaggaggactctgcctgtccagcagcagaggagagcctgccaatcgaagtgatggtggatgccgtgcacaagctgaagtacgagaattatacatctagcttctttatccgggacatcatcaagcccgatccccctaagaacctgcagctgaagcctctgaagaattctagacaggtggaggtgagctgggagtaccccgacacctggagcacacctcacagctatttctccctgaccttttgcgtgcaggtgcagggcaagtccaagagggagaagaaggaccgcgtgttcaccgataagacatctgccaccgtgatctgtcggaagaacgccagcatctccgtgagggcccaggatcgctactattcctctagctggtctgagtgggccagcgtgccctgttccggcggcggcggctctggaggaggaggcagcggcggaggaggctccagaaatctgccagtggccacccctgacccaggcatgttcccctgcctgcaccacagccagaacctgctgagggccgtgtccaatatgctgcagaaggcccgccagacactggagttttacccctgtaccagcgaggagatcgaccacgaggatatcacaaaggataagacctccacagtggaggcctgcctgcctctggagctgaccaagaacgagtcttgtctgaatagcagggagacatccttcatcaccaacggctcttgcctggccagccgcaagacatcctttatgatggccctgtgcctgtcctctatctacgaggacctgaagatgtatcaggtggagttcaagaccatgaacgccaagctgctgatggaccctaagaggcagatctttctggatcagaatatgctggccgtgatcgacgagctgatgcaggccctgaacttcaattccgagacagtgcctcagaagagctccctggaggagccagatttctacaagaccaagatcaagctgtgcatcctgctgcacgcctttcggatcagagccgtgaccatcgaccgcgtgatgtcttatctgaatgccagcggatcc

SEQ ID NO: 213363 - DNA, 1986 bp, Artificial Sequence
  Description of Artificial Sequence: Synthetic polynucleotide
atgtgccaccagcagctggtcatctcttggttcagcctggtgtttctggcatccccactggtggcaatctgggagctgaagaaggacgtgtacgtggtggagctggactggtatcccgatgcccctggcgagatggtggtgctgacctgcgacacacctgaggaggatggcatcacctggacactggatcagagctccgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatctggtccacagacatcctgaaggatcagaaggagccaaagaacaagaccttcctgaggtgcgaggccaagaattattctggcaggttcacctgttggtggctgaccacaatcagcaccgatctgacattttccgtgaagtctagccggggctcctctgacccccagggagtgacatgcggagcagccaccctgtccgccgagagggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctagacaggtggaggtgagctgggagtacccagacacctggagcacaccccactcctatttctctctgaccttttgcgtgcaggtgcagggcaagagcaagagggagaagaaggacagagtgttcaccgataagacatccgccaccgtgatctgtcggaagaacgcctccatctctgtgcgggcccaggatcgctactattctagctcctggagcgagtgggcatccgtgccatgttctggaggaggaggcagcggcggaggaggctccggcggcggcggctctcgcaatctgccagtggcaacccctgacccaggaatgttcccttgcctgcaccacagccagaacctgctgcgggccgtgtccaatatgctgcagaaggcccgccagacactggagttttacccttgtacctctgaggagatcgaccacgaggatatcacaaaggataagaccagcacagtggaggcctgcctgccactggagctgaccaagaacgagagctgtctgaattccagggagacatctttcatcaccaacggcagctgcctggcctccagaaagacatcttttatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaattccgagacagtgccacagaagtcctctctggaggagcccgatttctacaagaccaagatcaagctgtgcatcctgctgcacgccttcaggatcagggccgtgaccatcgacagagtgatgagctatctgaacgccagcgagtccaggagagtgcggcgcaacaagaggagcaagggcgtgcaggtggagacaatcagccccggcgatggccggacctttcctaagcgcggccagacatgcgtggtgcactacaccggcatgctgggcgacggcaagaaggtggacagctccagggatagaaacaagccattcaagtttatgctgggcaagcaggaagtgatcagaggatgggaggagggagtggcacagatgtccgtgggacagggcgccaagctgacaatctctccagattacgcatatggagcaaccggacacccaggaatcatcccaccccacgccaccctggtgttcgacgtggagctgctggagctggagtgaggatcc

SEQ ID NO: 213364 - DNA, 603 bp, Artificial Sequence
  Description of Artificial Sequence: Synthetic Promoter
aagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctactaga

SEQ ID NO: 213365 - DNA, 1339 bp, Artificial Sequence
  Description of Artificial Sequence: Synthetic Promoter
cgatagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgag

SEQ ID NO: 213366 - DNA, 399 bp, Artificial Sequence
  Description of Artificial Sequence: Synthetic Promoter
ccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcagcc

SEQ ID NO: 213367 - protein, 311 aa, Renilla reniformis
MTSKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQ

SEQ ID NO: 213368 - protein, 550 aa, Photinus pyralis
MEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKSKL

SEQ ID NO: 213369 - protein, 108 aa, Artificial Sequence
  Description of Artificial Sequence: Synthetic Destabilized Domain (DD)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 213370 - protein, 108 aa, Artificial Sequence; identical to SEQ ID NO: 213369
  Description of Artificial Sequence: Synthetic Destabilized Domain (DD)

SEQ ID NO: 213371 - protein, 159 aa, Artificial Sequence
  Description of Artificial Sequence: Synthetic Destabilized Domain (DD)
MISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERR

SEQ ID NO: 213372 - protein, 311 aa, Artificial Sequence; identical to SEQ ID NO: 213367
  Description of Artificial Sequence: Synthetic polypeptide

SEQ ID NO: 213373 - protein, 660 aa, Artificial Sequence
  Description of Artificial Sequence: Synthetic polypeptide
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEEFMEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKSKL

SEQ ID NO: 213374 - protein, 420 aa, Artificial Sequence
  Description of Artificial Sequence: Synthetic polypeptide
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPESGTSKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQ

SEQ ID NO: 213375 - protein, 471 aa, Artificial Sequence
  Description of Artificial Sequence: Synthetic polypeptide
MISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERRSGTSKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQ

SEQ ID NO: 213376 - protein, 420 aa, Artificial Sequence
  Description of Artificial Sequence: Synthetic polypeptide
MTSKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQSGGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 213377 - protein, 471 aa, Artificial Sequence
  Description of Artificial Sequence: Synthetic polypeptide
MTSKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQSGISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERR

SEQ ID NO: 213378 - DNA, 936 bp, Renilla reniformis
atgacttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagtaa

SEQ ID NO: 213379 - DNA, 1653 bp, Photinus pyralis
atggaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagagcaagctgtga

SEQ ID NO: 213380 - DNA, 324 bp, Artificial Sequence
  Description of Artificial Sequence: Synthetic Destabilized Domain (DD)
atgggcgtgcaggttgagactataagcccaggcgacggcaggaccttccccaagaggggccagacatgcgtggtgcactacaccggcatgcttgaagacggcaaaaaggtggactcaagcagggacaggaacaagcccttcaagttcatgttgggcaaacaggaggtgatcagaggctgggaggagggtgttgcccagatgagcgtggggcagagggccaagctcacgataagtcccgattacgcctacggcgccaccggtcaccccggcatcatccccccacacgccaccctggtgttcgacgtggaattgctgaagcccgag

SEQ ID NO: 213381 - DNA, 324 bp, Artificial Sequence
  Description of Artificial Sequence: Synthetic Destabilized Domain (DD)
ggcgtgcaggttgagactataagcccaggcgacggcaggaccttccccaagaggggccagacatgcgtggtgcactacaccggcatgcttggcgacggcaaaaaggtggactcaagcagggacaggaacaagcccttcaagttcatgttgggcaaacaggaggtgatcagaggctgggaggagggtgttgcccagatgagcgtggggcagggcgccaagctcacgataagtcccgattacgcctacggcgccaccggtcaccccggcatcatccccccacacgccaccctggtgttcgacgtggaattgctggagctggagtga

SEQ ID NO: 213382 - DNA, 477 bp, Artificial Sequence
  Description of Artificial Sequence: Synthetic Destabilized Domain (DD)
atgatctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgt

SEQ ID NO: 213383 - DNA, 936 bp, Artificial Sequence; identical to SEQ ID NO: 213378
  Description of Artificial Sequence: Synthetic polynucleotide

SEQ ID NO: 213384 - DNA, 1983 bp, Artificial Sequence
  Description of Artificial Sequence: Synthetic polynucleotide
atgggcgtgcaggttgagactataagcccaggcgacggcaggaccttccccaagaggggccagacatgcgtggtgcactacaccggcatgcttgaagacggcaaaaaggtggactcaagcagggacaggaacaagcccttcaagttcatgttgggcaaacaggaggtgatcagaggctgggaggagggtgttgcccagatgagcgtggggcagagggccaagctcacgataagtcccgattacgcctacggcgccaccggtcaccccggcatcatccccccacacgccaccctggtgttcgacgtggaattgctgaagcccgaggagttcatggaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagagcaagctgtga

SEQ ID NO: 213385 - DNA, 1263 bp, Artificial Sequence
  Description of Artificial Sequence: Synthetic polynucleotide
atgggcgtgcaggttgagactataagcccaggcgacggcaggaccttccccaagaggggccagacatgcgtggtgcactacaccggcatgcttgaagacggcaaaaaggtggactcaagcagggacaggaacaagcccttcaagttcatgttgggcaaacaggaggtgatcagaggctgggaggagggtgttgcccagatgagcgtggggcagagggccaagctcacgataagtcccgattacgcctacggcgccaccggtcaccccggcatcatccccccacacgccaccctggtgttcgacgtggaattgctgaagcccgagagcggcacttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagtaa

SEQ ID NO: 213386 - DNA, 1416 bp, Artificial Sequence
  Description of Artificial Sequence: Synthetic polynucleotide
atgatctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgtagcggcacttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagtaa

SEQ ID NO: 213387 - DNA, 1263 bp, Artificial Sequence
  Description of Artificial Sequence: Synthetic polynucleotide
atgacttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagagcggcggcgtgcaggttgagactataagcccaggcgacggcaggaccttccccaagaggggccagacatgcgtggtgcactacaccggcatgcttggcgacggcaaaaaggtggactcaagcagggacaggaacaagcccttcaagttcatgttgggcaaacaggaggtgatcagaggctgggaggagggtgttgcccagatgagcgtggggcagggcgccaagctcacgataagtcccgattacgcctacggcgccaccggtcaccccggcatcatccccccacacgccaccctggtgttcgacgtggaattgctggagctggagtga

SEQ ID NO: 213388 - DNA, 1416 bp, Artificial Sequence
  Description of Artificial Sequence: Synthetic polynucleotide
atgacttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagagcggcatctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgttga

SEQ ID NO: 213389 - protein, 114 aa, Homo sapiens
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 213390 - protein, 134 aa, Artificial Sequence
  Description of Artificial Sequence: Synthetic polypeptide
MYRMQLLSCIALSLALVTNSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 213391 - protein, 303 aa, Artificial Sequence
  Description of Artificial Sequence: Synthetic polypeptide
MYRMQLLSCIALSLALVTNSEFSTEFISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERRGGSGGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 213392 - DNA, 60 bp, Artificial Sequence
  Description of Artificial Sequence: Synthetic Signal Sequence
atgtacaggatgcagctgctgagctgcatcgccctgagcctggccctggtgaccaacagc

SEQ ID NO: 213393 - DNA, 60 bp, Artificial Sequence
  Description of Artificial Sequence: Synthetic Signal Sequence
atgtacagaatgcagctgctgagctgcatcgccctgtccctcgccctggtgaccaactcc

SEQ ID NO: 213394 - DNA, 18 bp, Artificial Sequence
  Description of Artificial Sequence: Synthetic Linker sequence
gagttctccaccgagttc

SEQ ID NO: 213395 - DNA, 15 bp, Artificial Sequence
  Description of Artificial Sequence: Synthetic Linker sequence
ggaggcagcggagga

SEQ ID NO: 213396 - DNA, 15 bp, Artificial Sequence
  Description of Artificial Sequence: Synthetic Linker sequence
ggaggctctggagga

SEQ ID NO: 213397 - DNA, 15 bp, Artificial Sequence
  Description of Artificial Sequence: Synthetic Linker sequence
ggaggctccggcgga

SEQ ID NO: 213398 - DNA, 345 bp, Homo sapiens
aactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttga

SEQ ID NO: 213399 - DNA, 345 bp, Artificial Sequence
  Description of Artificial Sequence: Synthetic polynucleotide
aactgggtgaacgtgatctccgacctgaagaagatcgaggacctgatccagtccatgcacatcgacgccaccctgtacaccgagagcgacgtgcaccctagctgcaaggtgaccgccatgaagtgcttcctgctggagctgcaggtgatcagcctggagagcggcgatgccagcatccacgacacagtggagaacctgatcatcctggccaacaacagcctgagcagcaacggcaatgtgaccgagagcggctgcaaggagtgcgaggagctggaggagaagaacatcaaggagttcctgcagtccttcgtgcacatcgtgcagatgttcatcaacaccagctaa

SEQ ID NO: 213400 - DNA, 345 bp, Artificial Sequence
  Description of Artificial Sequence: Synthetic polynucleotide
aactgggtcaacgtgatcagcgacctgaagaagatcgaggacctcatccagtccatgcacattgacgccaccctgtacaccgagtccgatgtgcaccctagctgcaaggtgaccgccatgaaatgcttcctgctggagctgcaggtcatctccttagaaagcggcgatgcctccatccacgacaccgtggagaacctgatcatcctggccaataactccctgagcagcaacggcaacgtgaccgagagcggctgcaaagagtgtgaagagctggaggagaagaacattaaggagttcctgcagagcttcgtgcacatcgtgcaaatgttcatcaacaccagctaa

SEQ ID NO: 213401 - DNA, 342 bp, Artificial Sequence
  Description of Artificial Sequence: Synthetic polynucleotide
aactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttct

SEQ ID NO: 213402 - DNA, 474 bp, Artificial Sequence
  Description of Artificial Sequence: Synthetic Destabilizing Domain (DD) sequence
atctccctgatcgccgccctggccgtggattatgtgatcggcatggagaacgccatgccctggaatctgcccgccgacctggcctggttcaagaggaataccctgaacaagcccgtcatcatgggcaggcacacctgggaaagcatcggcagacccctgcccggcaggaagaacatcatcctgtccagccagcccggcaccgacgacagagtgacctgggtgaagagcgtggacgaagctatcgccgcttgcggcgacgtgcccgagatcatggtgatcggcggcggcagggtgatcgaacagttcctgcccaaggcccagaagctgtacctgacccacatcgatgccgaggtggaaggcgatacacacttccccgattacgaacctgacgactgggaaagcgtgttttccgaattccacgacgccgacgcccagaacagccacagctactgcttcgagatcctggaaagaagg

SEQ ID NO: 213403 - DNA, 405 bp, Artificial Sequence
  Description of Artificial Sequence: Synthetic polynucleotide
atgtacaggatgcagctgctgagctgcatcgccctgagcctggccctggtgaccaacagcaactgggtgaacgtgatctccgacctgaagaagatcgaggacctgatccagtccatgcacatcgacgccaccctgtacaccgagagcgacgtgcaccctagctgcaaggtgaccgccatgaagtgcttcctgctggagctgcaggtgatcagcctggagagcggcgatgccagcatccacgacacagtggagaacctgatcatcctggccaacaacagcctgagcagcaacggcaatgtgaccgagagcggctgcaaggagtgcgaggagctggaggagaagaacatcaaggagttcctgcagtccttcgtgcacatcgtgcagatgttcatcaacaccagctaa

SEQ ID NO: 213404 - DNA, 912 bp, Artificial Sequence
  Description of Artificial Sequence: Synthetic polynucleotide
atgtacagaatgcagctgctgagctgcatcgccctgtccctcgccctggtgaccaactccgagttctccaccgagttcatctccctgatcgccgccctggccgtggattatgtgatcggcatggagaacgccatgccctggaatctgcccgccgacctggcctggttcaagaggaataccctgaacaagcccgtcatcatgggcaggcacacctgggaaagcatcggcagacccctgcccggcaggaagaacatcatcctgtccagccagcccggcaccgacgacagagtgacctgggtgaagagcgtggacgaagctatcgccgcttgcggcgacgtgcccgagatcatggtgatcggcggcggcagggtgatcgaacagttcctgcccaaggcccagaagctgtacctgacccacatcgatgccgaggtggaaggcgatacacacttccccgattacgaacctgacgactgggaaagcgtgttttccgaattccacgacgccgacgcccagaacagccacagctactgcttcgagatcctggaaagaaggggaggctccggcggaaactgggtcaacgtgatcagcgacctgaagaagatcgaggacctcatccagtccatgcacattgacgccaccctgtacaccgagtccgatgtgcaccctagctgcaaggtgaccgccatgaaatgcttcctgctggagctgcaggtcatctccttagaaagcggcgatgcctccatccacgacaccgtggagaacctgatcatcctggccaataactccctgagcagcaacggcaacgtgaccgagagcggctgcaaagagtgtgaagagctggaggagaagaacattaaggagttcctgcagagcttcgtgcacatcgtgcaaatgttcatcaacaccagctaa

SEQ ID NO: 213405 - protein, 242 aa, Artificial Sequence
  Description of Artificial Sequence: Synthetic CD19 scFv sequence
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 213406 - protein, 69 aa, Homo sapiens
TTTPAPRPPTPAPTIASQPLSLRPEACRPAAGGAVHTRGLDFACDIYIWAPLAGTCGVLLLSLVITLYC

SEQ ID NO: 213407 - protein, 112 aa, Homo sapiens
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 213408 - protein, 42 aa, Homo sapiens
KRGRKKLLYIFKQPFMRPVQTTQEEDGCSCRFPEEEEGGCEL

SEQ ID NO: 213409 - protein, 21 aa, Homo sapiens
MALPVTALLLPLALLLHAARP

SEQ ID NO: 213410 - protein, 158 aa, Artificial Sequence
  Description of Artificial Sequence: Synthetic polypeptide
ISLIAALAVDHVIGMENAMPWNLPADLAWFKRNTLNKPVIMGRHTWESIGRPLPGRKNIILSSQPGTDDRVTWVKSVDEAIAACGDVPEIMVIGGGRVYEQFLPKAQKLYLTHIDAEVEGDTHFPDYKPDDWESVFSEFHDADAQNSHSYCFEILERR

SEQ ID NO: 213411 - protein, 486 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 213412 - protein, 593 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPETTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 213413 - protein, 644 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 213414 - protein, 593 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 213415 - protein, 644 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERRIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 213416 - protein, 649 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGSGGISLIAALAVDHVIGMENAMPWNLPADLAWFKRNTLNKPVIMGRHTWESIGRPLPGRKNIILSSQPGTDDRVTWVKSVDEAIAACGDVPEIMVIGGGRVYEQFLPKAQKLYLTHIDAEVEGDTHFPDYKPDDWESVFSEFHDADAQNSHSYCFEILERR

SEQ ID NO: 213417 - protein, 598 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGSGGGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 213418 - DNA, 726 bp, Artificial Sequence
  Description of Artificial Sequence: Synthetic CD19 scFv sequence
gacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagc

SEQ ID NO: 213419 - DNA, 726 bp, Artificial Sequence
  Description of Artificial Sequence: Synthetic CD19 scFv sequence
gacatccagatgacacagaccacaagctccctgagcgcctccctgggcgacagagtgaccatctcttgccgggccagccaggatatctccaagtatctgaactggtaccagcagaagcccgatggcacagtgaagctgctgatctatcacacctctcgcctgcacagcggcgtgccttccaggttctctggcagcggctccggcacagactactctctgaccatcagcaacctggagcaggaggatatcgccacctatttctgccagcagggcaatacactgccctacacctttggcggcggcacaaagctggagatcaccggcggcggcggctctggaggaggaggcagcggcggaggaggctccgaggtgaagctgcaggagtccggaccaggcctggtggcaccatctcagagcctgtccgtgacatgtaccgtgagcggcgtgtccctgcctgactacggcgtgagctggatcagacagccacctaggaagggcctggagtggctgggcgtgatctggggctccgagacaacatactataactccgccctgaagtctcggctgaccatcatcaaggacaactctaagagccaggtgttcctgaagatgaattccctgcagacagacgataccgccatctactattgcgccaagcactactattacggcggctcctatgccatggattactggggccagggcacatctgtgaccgtgtctagc

SEQ ID NO: 213420 - DNA, 726 bp, Artificial Sequence
  Description of Artificial Sequence: Synthetic CD19 scFv sequence
gacatccagatgacacagaccacaagctccctgagcgcctccctgggcgacagagtgaccatcagctgccgggcctcccaggatatctctaagtatctgaactggtaccagcagaagccagatggcacagtgaagctgctgatctatcacaccagccgcctgcactccggagtgccctctaggttctctggcagcggctccggcacagactacagcctgaccatctccaacctggagcaggaggatatcgccacctatttctgccagcagggcaatacactgccatacacctttggcggcggcacaaagctggagatcaccggaggaggaggcagcggaggaggaggctccggcggcggcggctctgaggtgaagctgcaggagtccggaccaggcctggtggcaccttctcagagcctgtccgtgacatgtaccgtgtctggcgtgagcctgcccgactacggcgtgtcttggatcagacagccacctaggaagggcctggagtggctgggcgtgatctggggcagcgagacaacatactataattctgccctgaagagcaggctgaccatcatcaaggacaactctaagagccaggtgttcctgaagatgaattccctgcagacagacgataccgccatctactattgcgccaagcactactattacggcggctcttatgccatggattactggggccagggcacaagcgtgaccgtgtctagc

SEQ ID NO: 213421 - DNA, 726 bp, Artificial Sequence
  Description of Artificial Sequence: Synthetic CD19 scFv sequence
gacatccagatgacacagaccacaagctccctgagcgcctccctgggcgacagagtgaccatctcttgccgggccagccaggatatctccaagtatctgaactggtaccagcagaagccagatggcacagtgaagctgctgatctatcacacctctcgcctgcacagcggagtgccctccaggttctctggcagcggctccggcacagactactctctgaccatcagcaacctggagcaggaggatatcgccacctatttctgccagcagggcaatacactgccctacacctttggcggcggcacaaagctggagatcaccggcggcggcggctctggaggaggaggcagcggcggaggaggctccgaggtgaagctgcaggagtccggaccaggcctggtggcaccatctcagagcctgtccgtgacatgtaccgtgagcggcgtgtccctgcctgactacggcgtgagctggatcagacagccacctaggaagggcctggagtggctgggcgtgatctggggctccgagacaacatactataattccgccctgaagtctcggctgacaatcatcaaggacaactctaagagccaggtgtttctgaagatgaatagcctgcagacagacgataccgccatctactattgcgccaagcactactattacggcggctcctatgccatggattactggggccagggcacatctgtgaccgtgtctagc

SEQ ID NO: 213422 - DNA, 726 bp, Artificial Sequence
  Description of Artificial Sequence: Synthetic CD19 scFv sequence
gacatccagatgacacagaccacaagctccctgagcgcctccctgggcgacagagtgaccatcagctgccgggcctcccaggatatctctaagtatctgaactggtaccagcagaagccagatggcacagtgaagctgctgatctatcacaccagccgcctgcactccggagtgccctctaggttctctggcagcggctccggcacagactacagcctgaccatctccaacctggagcaggaggatatcgccacctatttctgccagcagggcaatacactgccatacacctttggcggcggcacaaagctggagatcaccggaggaggaggcagcggaggaggaggctccggcggcggcggctctgaggtgaagctgcaggagtccggaccaggcctggtggcaccttctcagagcctgtccgtgacatgtaccgtgtctggcgtgagcctgcccgactacggcgtgtcttggatcagacagccacctaggaagggcctggagtggctgggcgtgatctggggcagcgagacaacatactataattctgccctgaagagcaggctgacaatcatcaaggacaactctaagagccaggtgtttctgaagatgaatagcctgcagacagacgataccgccatctactattgtgccaagcactactattacggcggcagctatgccatggattactggggccagggcacatccgtgaccgtgtctagc

SEQ ID NO: 213423 - DNA, 207 bp, Homo sapiens
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgc

SEQ ID NO: 213424 - DNA, 207 bp, Artificial Sequence
  Description of Artificial Sequence: Synthetic polynucleotide
accacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgc

SEQ ID NO: 213425 - DNA, 207 bp, Artificial Sequence
  Description of Artificial Sequence: Synthetic polynucleotide
acaacaaccccagcacccagacctccaacacctgcaccaaccatcgcaagccagcctctgtccctgaggcccgaggcatgtaggccagcagcaggaggcgccgtgcacacccggggcctggactttgcctgcgatatctatatctgggcaccactggcaggaacatgtggcgtgctgctgctgtccctggtcatcaccctgtattgc

SEQ ID NO: 213426 - DNA, 207 bp, Artificial Sequence
  Description of Artificial Sequence: Synthetic polynucleotide
accacaaccccagcaccccgcccaccaacacctgcaccaaccatcgcctcccagccactgtctctgaggcccgaggcatgtaggcctgcagcaggaggcgccgtgcacaccaggggcctggactttgcctgcgatatctacatctgggcacctctggcaggaacatgtggcgtgctgctgctgtccctggtcatcaccctgtattgc

SEQ ID NO: 213427 - DNA, 207 bp, Artificial Sequence
  Description of Artificial Sequence: Synthetic polynucleotide
accacaaccccagcacccagaccaccaacacctgcaccaaccatcgcaagccagcctctgtccctgcgcccagaggcatgcaggccagcagcaggaggagcagtgcacacccggggcctggacttcgcatgtgatatctacatctgggcaccactggcaggaacatgcggcgtgctgctgctgtccctggtcatcaccctgtattgt

SEQ ID NO: 213428 - DNA, 207 bp, Artificial Sequence
  Description of Artificial Sequence: Synthetic polynucleotide
accacaaccccagcacctcgcccaccaacaccagcaccaaccatcgcatcccagccactgtctctgcgccccgaggcatgcaggcctgcagcaggcggcgccgtgcacaccaggggcctggacttcgcctgtgatatctacatctgggcacctctggcaggaacatgcggcgtgctgctgctgtctctggtcatcaccctgtattgt

SEQ ID NO: 213429 - DNA, 338 bp, Artificial Sequence
  Description of Artificial Sequence: Synthetic polynucleotide
agggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggtg

SEQ ID NO: 213430 - DNA, 338 bp, Artificial Sequence
  Description of Artificial Sequence: Synthetic polynucleotide
agggtgaagttttccaggtctgccgatgcccccgcctataagcagggccagaatcagctgtacaacgagctgaatctgggcaggagagaggagtacgacgtgctggataagaggaggggacgcgaccccgagatgggaggcaagcctaggagaaagaacccacaggagggcctgtataatgagctgcagaaggacaagatggccgaggcctactctgagatcggcatgaagggagagcggcgcaggggcaagggacacgatggcctgtatcagggcctgagcacagccaccaaggacacctacgatgcactgcacatgcaggccctgccacctaggtg

SEQ ID NO: 213431 - DNA, 338 bp, Artificial Sequence
  Description of Artificial Sequence: Synthetic polynucleotide
agggtgaagtttagcaggtccgccgatgccccagcctataagcagggccagaaccagctgtacaacgagctgaatctgggcaggagggaagagtacgacgtgctggataagaggagaggaagggaccccgagatgggaggcaagccaaggaggaagaacccacaggagggcctgtataatgagctgcagaaggacaagatggccgaggcctacagcgagatcggcatgaagggagagaggagacggggcaagggacacgatggcctgtatcagggcctgtccacagccaccaaggacacctacgatgcactgcacatgcaggccctgcctccaaggtg

SEQ ID NO: 213432 - DNA, 338 bp, Artificial Sequence
  Description of Artificial Sequence: Synthetic polynucleotide
agggtgaagttttccaggtctgccgatgccccagcctataagcagggccagaatcagctgtacaacgagctgaatctgggcaggagagaggagtacgacgtgctggataagaggaggggacgcgaccccgagatgggaggcaagcctaggagaaagaacccacaggagggcctgtataatgagctgcagaaggacaagatggccgaggcctactctgagatcggcatgaagggagagcggcgcaggggcaagggacacgatggcctgtatcagggcctgagcacagccaccaaggacacctacgatgcactgcacatgcaggccctgccacctaggtg

SEQ ID NO: 213433 - DNA, 338 bp, Artificial Sequence
  Description of Artificial Sequence: Synthetic polynucleotide
agggtgaagtttagcaggtccgccgatgccccagcctataagcagggccagaaccagctgtacaacgagctgaatctgggcaggagggaagagtacgacgtgctggataagaggagaggaagggaccccgagatgggaggcaagccaaggaggaagaacccacaggagggcctgtataatgagctgcagaaggacaagatggccgaggcctactccgagatcggcatgaagggagagaggagacggggcaagggacacgatggcctgtatcagggcctgtctacagccaccaaggacacctacgatgcactgcacatgcaggccctgcctccaaggtg

SEQ ID NO: 213434 - DNA, 126 bp, Artificial Sequence
  Description of Artificial Sequence: Synthetic polynucleotide
aagagaggccggaagaagctgctgtacatcttcaagcagcccttcatgaggcccgtgcagacaacccaggaggaggacggctgcagctgtcggttcccagaggaggaggagggaggatgtgagctg

SEQ ID NO: 213435 - DNA, 126 bp, Artificial Sequence
  Description of Artificial Sequence: Synthetic polynucleotide
aagcgcggcaggaagaagctgctgtacatcttcaagcagccctttatgcgccctgtgcagacaacccaggaggaggacggctgcagctgtaggttcccagaggaggaggagggaggatgtgagctg

SEQ ID NO: 213436 - DNA, 126 bp, Artificial Sequence
  Description of Artificial Sequence: Synthetic polynucleotide
aagcgcggcaggaagaagctgctgtacatcttcaagcagccttttatgcgcccagtgcagacaacccaggaggaggacggctgcagctgtaggttccctgaggaggaggagggaggatgtgagctg

SEQ ID NO: 213437 - DNA, 126 bp, Artificial Sequence
  Description of Artificial Sequence: Synthetic polynucleotide
aagcgcggcaggaagaagctgctgtacatcttcaagcagccctttatgcgccctgtgcagacaacccaggaggaggacggctgcagctgtaggttccctgaggaggaggagggaggatgtgagctg

SEQ ID NO: 213438 - DNA, 126 bp, Artificial Sequence
  Description of Artificial Sequence: Synthetic polynucleotide
aagcgcggcaggaagaagctgctgtacatcttcaagcagccttttatgcgcccagtgcagacaacccaggaggaggacggctgcagctgtaggttccctgaggaggaggagggaggatgcgagctg

SEQ ID NO: 213439 - DNA, 63 bp, Homo sapiens
atggccttaccagtgaccgccttgctcctgccgctggccttgctgctccacgccgccaggccg

SEQ ID NO: 213440 - DNA, 63 bp, Artificial Sequence
  Description of Artificial Sequence: Synthetic Signal Sequence
atggcactgcctgtgaccgccctgctgctgccactggccctgctgctgcacgcagccaggccc

SEQ ID NO: 213441 - DNA, 63 bp, Artificial Sequence
  Description of Artificial Sequence: Synthetic Signal Sequence
atggcactgccagtgacagccctgctgctgcctctggccctgctgctgcacgcagccagacct

SEQ ID NO: 213442 - DNA, 63 bp, Artificial Sequence
  Description of Artificial Sequence: Synthetic Signal Sequence
atggcactgcctgtgacagccctgctgctgccactggccctgctgctgcacgcagcccgccct

SEQ ID NO: 213443 - DNA, 63 bp, Artificial Sequence
  Description of Artificial Sequence: Synthetic Signal Sequence
atggcactgcctgtgaccgccctgctgctgccactggccctgctgctgcacgcagcccgccct

SEQ ID NO: 213444 - DNA, 321 bp, Artificial Sequence
  Description of Artificial Sequence: Synthetic Destabilizing Domain (DD) sequence
ggcgtgcaggtggagacaatcagcccaggcgacggacgcacctttccaaagaggggacagacatgcgtggtgcactacaccggcatgctggaggatggcaagaaggtggactcctctagagatcggaataagccattcaagtttatgctgggcaagcaggaagtgatcagaggctgggaggagggagtggcacagatgtctgtgggacagcgggccaagctgacaatcagccctgactatgcatacggagcaaccggacacccaggaatcatcccaccacacgccacactggtgttcgatgtggagctgctgaagcctgag

SEQ ID NO: 213445 - DNA, 321 bp, Artificial Sequence
  Description of Artificial Sequence: Synthetic Destabilizing Domain (DD) sequence
ggagtgcaggtggagacaatctccccaggcgacggcagaacctttcccaagcggggccagacatgcgtggtgcactataccggcatgctggaggatggcaagaaggtggactcctctagagatcggaacaagccattcaagtttatgctgggcaagcaggaagtgatcagaggctgggaggagggagtggcacagatgtctgtgggacagcgggccaagctgacaatcagcccagactatgcatacggagcaaccggacaccctggaatcatccctccacacgccaccctggtgttcgatgtggagctgctgaagcctgag

SEQ ID NO: 213446 - DNA, 324 bp, Artificial Sequence
  Description of Artificial Sequence: Synthetic Destabilizing Domain (DD) sequence
ggagtgcaggtggagacaatcagcccaggcgacggaaggacattcccaaagaggggacagacctgcgtggtgcactacacaggcatgctgggcgatggcaagaaggtggacagctcccgggatagaaacaagcccttcaagtttatgctgggcaagcaggaagtgatcaggggatgggaggagggagtggcacagatgtccgtgggacagggcgccaagctgaccatctctcctgactacgcctatggagcaacaggacacccaggaatcatcccacctcacgccaccctggtgtttgatgtggagctgctggagctggagtga

SEQ ID NO: 213447 - DNA, 474 bp, Artificial Sequence
  Description of Artificial Sequence: Synthetic Destabilizing Domain (DD) sequence
atctccctgatcgccgccctggcagtggactacgtgatcggcatggagaacgccatgccctggaatctgcctgccgatctggcctggtttaagagaaacacactgaataagcccgtgatcatgggccggcacacctgggagtctatcggcaggcccctgcctggcaggaagaacatcatcctgtcctctcagcctggcacagacgatagagtgacctgggtgaagagcgtggacgaggcaatcgcagcatgtggcgatgtgcccgagatcatggtcatcggcggcggcagagtgatcgagcagttcctgcctaaggcccagaagctgtatctgacacacatcgacgccgaggtggagggcgacacccactttccagattacgagcccgacgattgggagtccgtgttctctgagtttcacgacgccgatgcccagaattcccactcttattgcttcgagatcctggagaggaga

SEQ ID NO: 213448 - DNA, 474 bp, Artificial Sequence
  Description of Artificial Sequence: Synthetic Destabilizing Domain (DD) sequence
atctccctgatcgccgccctggcagtggactacgtgatcggcatggagaacgccatgccctggaatctgcctgccgatctggcctggtttaagagaaacacactgaataagcccgtgatcatgggccggcacacctgggagagcatcggcagacctctgccaggccggaagaacatcatcctgtcctctcagcctggcacagacgatagagtgacctgggtgaagtccgtggacgaggcaatcgcagcatgcggcgatgtgcccgagatcatggtcatcggcggcggcagagtgatcgagcagttcctgcctaaggcccagaagctgtatctgacacacatcgacgccgaggtggagggcgacacccactttccagattacgagcccgacgattgggagtccgtgttctctgagtttcacgacgccgatgcccagaattcccactcttattgtttcgagatcctggagagaaga

SEQ ID NO: 213449 - DNA, 477 bp, Artificial Sequence
  Description of Artificial Sequence: Synthetic Destabilizing Domain (DD) sequence
atctccctgatcgccgccctggcagtggaccacgtgatcggcatggagaacgccatgccatggaatctgcccgccgatctggcctggttcaagcggaacaccctgaataagccagtgatcatgggcagacacacatgggagtctatcggcaggcccctgcctggacgcaagaacatcatcctgagctcccagcccggcaccgacgatagggtgacatgggtgaagtccgtggacgaggcaatcgcagcatgcggcgatgtgcccgagatcatggtcatcggcggcggcagagtgtacgagcagttcctgcctaaggcccagaagctgtatctgacccacatcgacgccgaggtggagggcgacacacactttcctgattacaagccagacgattgggagtccgtgttctctgagtttcacgacgccgatgcccagaattctcacagctattgttttgagatcctggagcggagatga

SEQ ID NO: 213450 - DNA, 1460 bp, Artificial Sequence
  Description of Artificial Sequence: Synthetic polynucleotide
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggtg

SEQ ID NO: 213451 - DNA, 1781 bp, Artificial Sequence
  Description of Artificial Sequence: Synthetic polynucleotide
atggcactgccagtgacagccctgctgctgcctctggccctgctgctgcacgcagccagacctgacatccagatgacacagaccacaagctccctgagcgcctccctgggcgacagagtgaccatctcttgccgggccagccaggatatctccaagtatctgaactggtaccagcagaagcccgatggcacagtgaagctgctgatctatcacacctctcgcctgcacagcggcgtgccttccaggttctctggcagcggctccggcacagactactctctgaccatcagcaacctggagcaggaggatatcgccacctatttctgccagcagggcaatacactgccctacacctttggcggcggcacaaagctggagatcaccggcggcggcggctctggaggaggaggcagcggcggaggaggctccgaggtgaagctgcaggagtccggaccaggcctggtggcaccatctcagagcctgtccgtgacatgtaccgtgagcggcgtgtccctgcctgactacggcgtgagctggatcagacagccacctaggaagggcctggagtggctgggcgtgatctggggctccgagacaacatactataactccgccctgaagtctcggctgaccatcatcaaggacaactctaagagccaggtgttcctgaagatgaattccctgcagacagacgataccgccatctactattgcgccaagcactactattacggcggctcctatgccatggattactggggccagggcacatctgtgaccgtgtctagcggcgtgcaggtggagacaatcagcccaggcgacggacgcacctttccaaagaggggacagacatgcgtggtgcactacaccggcatgctggaggatggcaagaaggtggactcctctagagatcggaataagccattcaagtttatgctgggcaagcaggaagtgatcagaggctgggaggagggagtggcacagatgtctgtgggacagcgggccaagctgacaatcagccctgactatgcatacggagcaaccggacacccaggaatcatcccaccacacgccacactggtgttcgatgtggagctgctgaagcctgagacaacaaccccagcacccagacctccaacacctgcaccaaccatcgcaagccagcctctgtccctgaggcccgaggcatgtaggccagcagcaggaggcgccgtgcacacccggggcctggactttgcctgcgatatctatatctgggcaccactggcaggaacatgtggcgtgctgctgctgtccctggtcatcaccctgtattgcaagcgcggcaggaagaagctgctgtacatcttcaagcagccctttatgcgccctgtgcagacaacccaggaggaggacggctgcagctgtaggttcccagaggaggaggagggaggatgtgagctgagggtgaagttttccaggtctgccgatgcccccgcctataagcagggccagaatcagctgtacaacgagctgaatctgggcaggagagaggagtacgacgtgctggataagaggaggggacgcgaccccgagatgggaggcaagcctaggagaaagaacccacaggagggcctgtataatgagctgcagaaggacaagatggccgaggcctactctgagatcggcatgaagggagagcggcgcaggggcaagggacacgatggcctgtatcagggcctgagcacagccaccaaggacacctacgatgcactgcacatgcaggccctgccacctaggtg

SEQ ID NO: 213452 - DNA, 1934 bp, Artificial Sequence
  Description of Artificial Sequence: Synthetic polynucleotide
atggcactgcctgtgacagccctgctgctgccactggccctgctgctgcacgcagcccgccctgacatccagatgacacagaccacaagctccctgagcgcctccctgggcgacagagtgaccatcagctgccgggcctcccaggatatctctaagtatctgaactggtaccagcagaagccagatggcacagtgaagctgctgatctatcacaccagccgcctgcactccggagtgccctctaggttctctggcagcggctccggcacagactacagcctgaccatctccaacctggagcaggaggatatcgccacctatttctgccagcagggcaatacactgccatacacctttggcggcggcacaaagctggagatcaccggaggaggaggcagcggaggaggaggctccggcggcggcggctctgaggtgaagctgcaggagtccggaccaggcctggtggcaccttctcagagcctgtccgtgacatgtaccgtgtctggcgtgagcctgcccgactacggcgtgtcttggatcagacagccacctaggaagggcctggagtggctgggcgtgatctggggcagcgagacaacatactataattctgccctgaagagcaggctgaccatcatcaaggacaactctaagagccaggtgttcctgaagatgaattccctgcagacagacgataccgccatctactattgcgccaagcactactattacggcggctcttatgccatggattactggggccagggcacaagcgtgaccgtgtctagcatctccctgatcgccgccctggcagtggactacgtgatcggcatggagaacgccatgccctggaatctgcctgccgatctggcctggtttaagagaaacacactgaataagcccgtgatcatgggccggcacacctgggagtctatcggcaggcccctgcctggcaggaagaacatcatcctgtcctctcagcctggcacagacgatagagtgacctgggtgaagagcgtggacgaggcaatcgcagcatgtggcgatgtgcccgagatcatggtcatcggcggcggcagagtgatcgagcagttcctgcctaaggcccagaagctgtatctgacacacatcgacgccgaggtggagggcgacacccactttccagattacgagcccgacgattgggagtccgtgttctctgagtttcacgacgccgatgcccagaattcccactcttattgcttcgagatcctggagaggagaaccacaaccccagcaccccgcccaccaacacctgcaccaaccatcgcctcccagccactgtctctgaggcccgaggcatgtaggcctgcagcaggaggcgccgtgcacaccaggggcctggactttgcctgcgatatctacatctgggcacctctggcaggaacatgtggcgtgctgctgctgtccctggtcatcaccctgtattgcaagcgcggcaggaagaagctgctgtacatcttcaagcagccttttatgcgcccagtgcagacaacccaggaggaggacggctgcagctgtaggttccctgaggaggaggagggaggatgtgagctgagggtgaagtttagcaggtccgccgatgccccagcctataagcagggccagaaccagctgtacaacgagctgaatctgggcaggagggaagagtacgacgtgctggataagaggagaggaagggaccccgagatgggaggcaagccaaggaggaagaacccacaggagggcctgtataatgagctgcagaaggacaagatggccgaggcctacagcgagatcggcatgaagggagagaggagacggggcaagggacacgatggcctgtatcagggcctgtccacagccaccaaggacacctacgatgcactgcacatgcaggccctgcctccaaggtg

SEQ ID NO: 213453 - DNA, 1781 bp, Artificial Sequence
  Description of Artificial Sequence: Synthetic polynucleotide
atggcactgccagtgacagccctgctgctgcctctggccctgctgctgcacgcagccagacctgacatccagatgacacagaccacaagctccctgagcgcctccctgggcgacagagtgaccatctcttgccgggccagccaggatatctccaagtatctgaactggtaccagcagaagccagatggcacagtgaagctgctgatctatcacacctctcgcctgcacagcggagtgccctccaggttctctggcagcggctccggcacagactactctctgaccatcagcaacctggagcaggaggatatcgccacctatttctgccagcagggcaatacactgccctacacctttggcggcggcacaaagctggagatcaccggcggcggcggctctggaggaggaggcagcggcggaggaggctccgaggtgaagctgcaggagtccggaccaggcctggtggcaccatctcagagcctgtccgtgacatgtaccgtgagcggcgtgtccctgcctgactacggcgtgagctggatcagacagccacctaggaagggcctggagtggctgggcgtgatctggggctccgagacaacatactataattccgccctgaagtctcggctgacaatcatcaaggacaactctaagagccaggtgtttctgaagatgaatagcctgcagacagacgataccgccatctactattgcgccaagcactactattacggcggctcctatgccatggattactggggccagggcacatctgtgaccgtgtctagcaccacaaccccagcacccagaccaccaacacctgcaccaaccatcgcaagccagcctctgtccctgcgcccagaggcatgcaggccagcagcaggaggagcagtgcacacccggggcctggacttcgcatgtgatggagtgcaggtggagacaatctccccaggcgacggcagaacctttcccaagcggggccagacatgcgtggtgcactataccggcatgctggaggatggcaagaaggtggactcctctagagatcggaacaagccattcaagtttatgctgggcaagcaggaagtgatcagaggctgggaggagggagtggcacagatgtctgtgggacagcgggccaagctgacaatcagcccagactatgcatacggagcaaccggacaccctggaatcatccctccacacgccaccctggtgttcgatgtggagctgctgaagcctgagatctacatctgggcaccactggcaggaacatgcggcgtgctgctgctgtccctggtcatcaccctgtattgtaagcgcggcaggaagaagctgctgtacatcttcaagcagccctttatgcgccctgtgcagacaacccaggaggaggacggctgcagctgtaggttccctgaggaggaggagggaggatgtgagctgagggtgaagttttccaggtctgccgatgccccagcctataagcagggccagaatcagctgtacaacgagctgaatctgggcaggagagaggagtacgacgtgctggataagaggaggggacgcgaccccgagatgggaggcaagcctaggagaaagaacccacaggagggcctgtataatgagctgcagaaggacaagatggccgaggcctactctgagatcggcatgaagggagagcggcgcaggggcaagggacacgatggcctgtatcagggcctgagcacagccaccaaggacacctacgatgcactgcacatgcaggccctgccacctaggtg

SEQ ID NO: 213454 - DNA, 1934 bp, Artificial Sequence
  Description of Artificial Sequence: Synthetic polynucleotide
atggcactgcctgtgaccgccctgctgctgccactggccctgctgctgcacgcagcccgccctgacatccagatgacacagaccacaagctccctgagcgcctccctgggcgacagagtgaccatcagctgccgggcctcccaggatatctctaagtatctgaactggtaccagcagaagccagatggcacagtgaagctgctgatctatcacaccagccgcctgcactccggagtgccctctaggttctctggcagcggctccggcacagactacagcctgaccatctccaacctggagcaggaggatatcgccacctatttctgccagcagggcaatacactgccatacacctttggcggcggcacaaagctggagatcaccggaggaggaggcagcggaggaggaggctccggcggcggcggctctgaggtgaagctgcaggagtccggaccaggcctggtggcaccttctcagagcctgtccgtgacatgtaccgtgtctggcgtgagcctgcccgactacggcgtgtcttggatcagacagccacctaggaagggcctggagtggctgggcgtgatctggggcagcgagacaacatactataattctgccctgaagagcaggctgacaatcatcaaggacaactctaagagccaggtgtttctgaagatgaatagcctgcagacagacgataccgccatctactattgtgccaagcactactattacggcggcagctatgccatggattactggggccagggcacatccgtgaccgtgtctagcaccacaaccccagcacctcgcccaccaacaccagcaccaaccatcgcatcccagccactgtctctgcgccccgaggcatgcaggcctgcagcaggcggcgccgtgcacaccaggggcctggacttcgcctgtgatatctccctgatcgccgccctggcagtggactacgtgatcggcatggagaacgccatgccctggaatctgcctgccgatctggcctggtttaagagaaacacactgaataagcccgtgatcatgggccggcacacctgggagagcatcggcagacctctgccaggccggaagaacatcatcctgtcctctcagcctggcacagacgatagagtgacctgggtgaagtccgtggacgaggcaatcgcagcatgcggcgatgtgcccgagatcatggtcatcggcggcggcagagtgatcgagcagttcctgcctaaggcccagaagctgtatctgacacacatcgacgccgaggtggagggcgacacccactttccagattacgagcccgacgattgggagtccgtgttctctgagtttcacgacgccgatgcccagaattcccactcttattgtttcgagatcctggagagaagaatctacatctgggcacctctggcaggaacatgcggcgtgctgctgctgtctctggtcatcaccctgtattgtaagcgcggcaggaagaagctgctgtacatcttcaagcagccttttatgcgcccagtgcagacaacccaggaggaggacggctgcagctgtaggttccctgaggaggaggagggaggatgcgagctgagggtgaagtttagcaggtccgccgatgccccagcctataagcagggccagaaccagctgtacaacgagctgaatctgggcaggagggaagagtacgacgtgctggataagaggagaggaagggaccccgagatgggaggcaagccaaggaggaagaacccacaggagggcctgtataatgagctgcagaaggacaagatggccgaggcctactccgagatcggcatgaagggagagaggagacggggcaagggacacgatggcctgtatcagggcctgtctacagccaccaaggacacctacgatgcactgcacatgcaggccctgcctccaaggtg

SEQ ID NO: 213455 - DNA, 1950 bp, Artificial Sequence
  Description of Artificial Sequence: Synthetic polynucleotide
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggggaggcagcggaggaatctccctgatcgccgccctggcagtggaccacgtgatcggcatggagaacgccatgccatggaatctgcccgccgatctggcctggttcaagcggaacaccctgaataagccagtgatcatgggcagacacacatgggagtctatcggcaggcccctgcctggacgcaagaacatcatcctgagctcccagcccggcaccgacgatagggtgacatgggtgaagtccgtggacgaggcaatcgcagcatgcggcgatgtgcccgagatcatggtcatcggcggcggcagagtgtacgagcagttcctgcctaaggcccagaagctgtatctgacccacatcgacgccgaggtggagggcgacacacactttcctgattacaagccagacgattgggagtccgtgttctctgagtttcacgacgccgatgcccagaattctcacagctattgttttgagatcctggagcggagatga

SEQ ID NO: 213456 - DNA, 1797 bp, Artificial Sequence
  Description of Artificial Sequence: Synthetic polynucleotide
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggggaggctctggaggaggagtgcaggtggagacaatcagcccaggcgacggaaggacattcccaaagaggggacagacctgcgtggtgcactacacaggcatgctgggcgatggcaagaaggtggacagctcccgggatagaaacaagcccttcaagtttatgctgggcaagcaggaagtgatcaggggatgggaggagggagtggcacagatgtccgtgggacagggcgccaagctgaccatctctcctgactacgcctatggagcaacaggacacccaggaatcatcccacctcacgccaccctggtgtttgatgtggagctgctggagctggagtga
